(12) United States Patent
Moss et al.

(10) Patent No.: US 12,297,469 B2
(45) Date of Patent: May 13, 2025

(54) METHODS AND COMPOSITIONS FOR INHIBITING ADAM10 BIOLOGICAL ACTIVITIES

(71) Applicant: VERRA THERAPEUTICS, INC., Lansing, NY (US)

(72) Inventors: Marcia L. Moss, Apex, NC (US); Robert Rasmussen, Lansing, NY (US); Chris Prince, Ithaca, NY (US)

(73) Assignee: VERRA THERAPEUTICS, INC., Lansing, NY (US)

( * ) Notice: Subject to any disclaimer, the term of this patent is extended or adjusted under 35 U.S.C. 154(b) by 207 days.

(21) Appl. No.: 17/748,163

(22) Filed: May 19, 2022

(65) Prior Publication Data

US 2023/0203468 A1    Jun. 29, 2023

Related U.S. Application Data

(63) Continuation of application No. 16/149,764, filed on Oct. 2, 2018, now abandoned.

(60) Provisional application No. 62/589,842, filed on Nov. 22, 2017, provisional application No. 62/566,580, filed on Oct. 2, 2017.

(51) Int. Cl.
| | | |
|---|---|---|
| *C12N 9/64* | (2006.01) | |
| *A61K 38/48* | (2006.01) | |
| *A61K 47/60* | (2017.01) | |
| *A61P 37/08* | (2006.01) | |

(52) U.S. Cl.
CPC ........ *C12N 9/6489* (2013.01); *A61K 38/4886* (2013.01); *A61K 47/60* (2017.08); *A61P 37/08* (2018.01)

(58) Field of Classification Search
CPC .. C12N 9/6489; A61K 38/4886; A61K 47/60; A61K 38/00; A61P 37/08; C12Y 304/24081
See application file for complete search history.

(56) References Cited

U.S. PATENT DOCUMENTS

| | | |
|---|---|---|
| 8,034,783 B2 | 10/2011 | Moss et al. |
| 2008/0096820 A1 | 4/2008 | Moss et al. |
| 2009/0285640 A1 | 11/2009 | Hilfiker et al. |
| 2009/0285840 A1 | 11/2009 | Blobel et al. |
| 2009/0297507 A1 | 12/2009 | Lai et al. |
| 2010/0111951 A1 | 5/2010 | Mather et al. |
| 2012/0130044 A1 | 5/2012 | Bachovchin et al. |
| 2013/0059788 A1 | 3/2013 | Moss et al. |

FOREIGN PATENT DOCUMENTS

| | | |
|---|---|---|
| WO | WO-2004/024089 A2 | 3/2004 |
| WO | WO-2012/064865 A1 | 5/2012 |
| WO | WO-2012/088105 A2 | 6/2012 |
| WO | WO-2015/117199 A1 | 8/2015 |

OTHER PUBLICATIONS

Timothy M. Smith Jr, Targeting ADAM10 in Cancer and Autoimmunity, Front. Immunol. 11:499, 2020.*
Mechanisms of Carcinogenesis, Secition 3, 2008, International Agency for Research on Cancer.*
Bertenshaw et al., Marked Differences between Metalloproteases Meprin A and B in Substrate and Peptide Bond Specificity, J. B. Chem., 276(16):13248-13255 (2001).
European Application No. 18865159.0, Supplementary European search report and Search Opinion, mailed Aug. 4, 2021.
European Application No. 18865159.0, Supplementary European search report and Search Opinion, mailed Dec. 22, 2021.
Hosaka et al., Arg-X-Lys/Arg-Arg Motif as a Signal for Precursor Cleavage Catalyzed by Furin within the Constitutive Secretory Pathway, J. Biol. Chem., 266(19):12127-30 (1991).
International Application No. PCT /US2018/053938, International Preliminary Report on Patentability, mailed Apr. 16, 2020.
Banerjee et al. (2011) American Journal of Physiology-Gastrointestinal and Liver Physiology 300:G273-282.
Bech-Serra et al. (2006) Proteomic identification of desmoglein 2 and activated leukocyte cell adhesion molecule as substrates of ADAM17 and ADAM10 by difference gel electrophoresis. Molecular and Cellular Biology 26(13):5086-95.
Bergin et al. (2008) Journal of Biological Chemistry 283:31736-31744.
Dreymueller et al. (2015) ADAM-family metalloproteinases in lung inflammation: potential therapeutic targets. American Journal of Physiology Lung Cellular and Molecular Physiology 308(4):L325-43.
Dreymueller et al., Consideration on inhibition approaches for proinflammatory functions of ADAM proteases, *Platelets (London)*. 28:354-61 (2017).
Fry et al. (2010) Secreted and membrane-bound isoforms of protease ADAM9 have opposing effects on breast cancer cell migration. Cancer Research 70(20):8187-8198.
Guaiquil et al. (2009) Molecular and Cellular Biology 29(10):2694-2703.
Hartmann et al. (2002) The disintegrin/metalloprotease ADAM 10 is essential for Notch signalling but not for a-secretase activity in fibroblasts. Human Molecular Genetics (11):2615-24.

(Continued)

*Primary Examiner* — Julie Ha
*Assistant Examiner* — Erinne R Dabkowski
(74) *Attorney, Agent, or Firm* — MARSHALL, GERSTEIN & BORUN LLP

(57) ABSTRACT

Provided are modified isolated ADAM10 modulating peptides and methods of using the same to modulate ADAM10 biological activities, inhibit ADAM10 biological activities associated with diseases, disorders, or conditions in subjects, including but not limited to decreasing inflammation and inhibiting undesirable cell proliferation. In some embodiments, the modified isolated ADAM10 modulating peptides are based on SEQ ID NO: 3 or SEQ ID NO: 4, and in some embodiments include modifications at or near the N-terminal and/or the C-terminal ends of the disclosed peptides as well as substitutions, insertions, and deletions at one or more amino acid positions of the ADAM10 prodomain peptides disclosed herein.

19 Claims, 13 Drawing Sheets

Specification includes a Sequence Listing.

(56) References Cited

OTHER PUBLICATIONS

Hwang et al., "Furin is an endogenous regulator of alpha-secretase associated APP processing", Biochemical and Biophysical Research Communication, 349:654-659 (2006).
International Search Report corresponding to International Patent Application No. PCT/US2018/053938 dated Feb. 5, 2019.
International Search Report corresponding to International Patent Application No. PCT/US2019/016015 dated Jun. 13, 2019.
Jefferson et al. (2013) The substrate degradome of meprin metalloproteases reveals an unexpected proteolytic link between meprin band ADAM10. Cellular and Molecular Life Sciences 70(2):309-333.
Lammich et al. (1999) Constitutive and regulated alpha-secretase cleavage of Alzheimer's amyloid precursor protein by a disintegrin metalloprotease. Proceedings of the National Academy of Sciences of the United States of America 96(7):3922-7.
Lemieux et al. (2007) The low affinity IgE receptor (CD23) is cleaved by the metalloproteinase ADAM10. The Journal of Biological Chemistry 282(20):14836-44.
Li et al. (2007) Metalloproteases regulate T-cell proliferation and effector function via LAG-3. The EMBO Journal 26(2):494-504.
Mathews et al. (2011) A potential new target for asthma therapy: a disintegrin and metalloprotease 10 (ADAM10) involvement in murine experimental asthma. Allergy 66(9):1193-200.
Mauch et al. (2010) Accelerated wound repair in ADAM-9 knockout animals. The Journal of Investigative Dermatology 130:2120-2130.
Moss et al. (2011) ADAM9 inhibition increases membrane activity of ADAM10 and controls a-secretase processing of amyloid precursor protein. Journal of Biological Chemistry 286(47):40443-40451.
Polverino et al. (2014) ADAM9 is upregulated in human COPD lungs and in human and murine lung in response to cigarette smoke European Respiratory Journal, 44(58):4856.
Roychaudhuri et al. (2014) ADAM9 is a Novel Product of Polymorphonuclear Neutrophils: Regulation of Expression and Contributions to Extracellular Matrix Protein Degradation during Acute Lung Injury, Journal of Immunology 193:2469-2482.
Sahin et al. (2004) Distinct roles for ADAM10 and ADAM17 in ectodomain shedding of six EGFR ligands. The Journal of Cell Biology 164(5):769-79.
Schelter et al. (2010) A disintegrin and metalloproteinase-10 (ADAM-10) mediates DN30 antibody-induced shedding of the met surface receptor. The Journal of Biological Chemistry 285(34):26335-40.
Vazeille et al. (2011) Role of meprins to protect ileal mucosa of Crohn's disease patients from colonization by adherent-invasive E. coli, PLoS One 6:e21199.
Waldhauer et al. (2008) Tumor-Associated MICA is shed by ADAM proteases. Cancer Research (68):6368-76.
Witters et al. (2008) Synergistic inhibition with a dual epidermal growth factor receptor/HER-2/neutyrosine kinase inhibitor and a disintegrin and metalloprotease inhibitor. Cancer Research 68(17):7083-9.
Wong et al. (2015) The Functional Maturation of a Disintegrin and Metalloproteinase (ADAM) 9, 10, and 17 Requires Processing at a Newly Identified Proprotein Convertase (PC) Cleavage Site. The Journal of Biological Chemistry 290(19):12135-46.
Wong et al. (2016) Harnessing the natural inhibitory domain to control TNFalpha Converting Enzyme (TACE) activity in vivo. Scientific Reports 6:35598.
Zhou et al. (2006) Targeting ADAM-mediated ligand cleavage to inhibit HERS and EGFR pathways in non-small cell lung cancer. Cancer Cell 10(1):39-50.
Wetzel et al., The metalloproteinase ADAM10: a useful therapeutic target?, Biochim. Biophys. Acta. Mol. Cell Res., 1864: 2071-2081, (2017).
Wong et al., The functional maturation of a disintegrin and metalloproteinase (ADAM) 9, 10, and 17 requires processing at a newly identified proprotein convertase (PC) cleavage site, J. Biol. Chem., 290(19): 12135-12146, (2015).

* cited by examiner

METHODS AND COMPOSITIONS FOR INHIBITING ADAM10 BIOLOGICAL ACTIVITIES

CROSS REFERENCE TO RELATED APPLICATIONS

This application is a continuation of U.S. patent application Ser. No. 16/149,764 filed Oct. 2, 2018, which claims the benefit of U.S. Provisional Patent Application Ser. Nos. 62/566,580 filed Oct. 2, 2017 and 62/589,842 filed Nov. 22, 2017. The disclosure of each of these applications is incorporated herein by reference in its entirety.

INCORPORATION BY REFERENCE OF SEQUENCE LISTING SUBMITTED ON COMPACT DISC

A Sequence Listing accompanies this application, an electronic copy of which is submitted on compact disc. Three identical compact discs are provided, labeled "Computer Readable Form," "Copy 1," and "Copy 2." Each compact disc conforms to the International Organization for Standardization (ISO) 9660 standard, and the contents of each compact disc is in compliance with the American Standard Code for Information Interchange (ASCII). The following file is included on the compact discs: "55630A_Seqlisting.txt." The Sequence Listing was created on May 10, 2022, and is 126,230,897 bytes in size. The subject matter of the Sequence Listing is incorporated by reference herein in its entirety.

TECHNICAL FIELD

The presently disclosed subject matter relates to compositions and methods pertaining to the inhibition of ADAM10 biological activities. In particular, the presently disclosed subject matter relates to modified ADAM10 prodomain peptides that, as a result of the modifications, exhibit increased stability to cleavage by furin and furin-like proteases and meprin and meprin-like proteases. The presently disclosed subject matter further relates to the use of said modified ADAM10 prodomain peptides in cellular assays, and to the use of said modified ADAM10 prodomain peptides for treatment of diseases, disorders, and conditions associated with undesirable ADAM10 biological activities such as cancer, inflammation, an allergic response, lupus, asthma, an infectious disease, and fibrosis.

BACKGROUND

ADAM10 is a member of the a disintegrin and metalloproteinase (ADAM) family (Edwards et al., 2008) that includes enzymes such as TACE (ADAM17), ADAM8, and ADAM9. In total, for humans, there are 33 ADAM family members. The ADAM proteins comprise a prodomain that is important for proper folding and transport of the enzyme through the cell, a catalytic domain containing a typical HEXXH motif, a disintegrin domain, that is used to interact with integrins, a cysteine rich region that is believed to be important for substrate recognition, a transmembrane domain, and a cytoplasmic tail that is involved in signaling events.

Members of the ADAM family are known to cleave type I and type II single membrane spanning proteins from cells to generate soluble mature proteins that have varying physiological roles (Edwards et al., 2008). For example, TACE is known to generate soluble epidermal growth factor (EGF) ligands such as TGF-alpha, amphiregulin, and HB-EGF (Sahin et al., 2004). Similarly, ADAM10 activity generates soluble proteins including, but not limited to, EGF ligands, EGF, HB-EGF, and betacellulin (Sahin et al., 2004), Notch, amyloid precursor protein, ephrins, cadherins, protocadherins, chemokines such as CXCL16 and CX3CL1, HER2, AXL, cMET, and CD23, a low affinity receptor for IgE (reviewed in Pruessmeyer & Ludwig, 2009). Disruption of ADAM10 activity has been shown to decrease the level of soluble non-amyloidogenic APP both in vivo and in cell-based assays, suggesting that maintaining ADAM10 activity may play a protective role in Alzheimer's disease for normal processing of soluble APP-α. In contrast, excess ADAM10 activity may promote cell growth in cancer proliferation assays due to enhanced production of soluble epidermal growth factor (EGF) ligands and activation of the Notch and TGF beta signaling pathways.

Inhibition of TACE activity is correlated with beneficial effects in a tumor cell proliferation assay (Witters et al., 2008). The mechanism for this inhibition of tumor cell proliferation is believed to be through prevention of EGF ligand release. For example, EGF ligands such as TGF-alpha, amphiregulin, HB-EGF, EGF and betacellulin, once released, are capable of activating the EGF receptor, which in turn leads to cancer proliferation (Pruessmeyer & Ludwig, 2009). Similar to TACE, ADAM10 promotes production of soluble EGF ligands such as EGF, HB-EGF, and betacellulin, however, unlike TACE, ADAM10 also generates soluble Notch and AXL that are known promoters of tumor cell proliferation (Pruessmeyer & Ludwig, 2009). Inhibition of ADAM10 prevents tumor proliferation (Crawford et al., 2009).

In addition to EGF ligands, ADAM10 also generates soluble CD23 (Lemieux et al., 2007). Release of CD23 promotes allergic responses through activation of IgE. Metalloproteinase inhibitors have been shown to block CD23 shedding and prevent allergic responses in both in vitro and in vivo assays (Mathews et al., 2011).

Accordingly, the ability to specifically modulate ADAM10 activity would be useful to study the biological functions of the protein, and for the treatment of disorders including but not limited to cancer, asthma, infectious diseases, and allergic responses.

Unfortunately, existing small molecule inhibitors are not specific for ADAM10 activity. For example, hydroxamates developed by GSK inhibit ADAM10 as well as other members of the matrix metalloproteinase family (Ludwig et al., 2005). Inhibitors disclosed by Incyte also inhibit matrix metalloproteinases (MMPs), and possibly other ADAM family members (Zhou et al., 2006). Such non-specific inhibition often leads to unwanted side effects, and in this case has prevented the compounds from being developed into pharmaceutical drugs (Moss et al., 2008).

ADAM family members are expressed as zymogens with the prodomains maintaining the enzymes in a latent state. For example, the prodomain of TACE suppresses the activity of its catalytic domain with a $K_i$ of 50 nM and inhibits TACE activity in vivo (Wong et al., 2016). The wild type prodomain of TACE, however, does not have good pharmacokinetic properties. Mutant prodomains that modified an upstream furin site and cysteine residue stabilized the TACE prodomain for in vivo use (Wong et al., 2016). Likewise, the wild type prodomain of ADAM10 does not have good pharmacokinetic properties, thereby making it difficult to be used as a drug. The reason for the poor pharmacokinetics could be due to processing by a furin convertase at the upstream cleavage site (amino acids 48-51), and/or processing by Meprin metalloproteinase, which was shown to cleave the prodomain of ADAM10 in vitro between amino acids 109 and 110. In addition, the sole cysteine at position 173 may interfere with the ability of the prodomain to have good pharmacokinetic properties as it can undergo oxidation to form a dimeric form of the prodomain.

Accordingly, there is a need in the art for selective inhibitors of ADAM10 to study the biological functions of the proteins and to treat diseases, disorders, and conditions associated with undesirable ADAM10 biological activities.

SUMMARY

This Summary lists several embodiments of the presently disclosed subject matter, and in many cases lists variations and permutations of these embodiments. This Summary is merely exemplary of the numerous and varied embodiments. Mention of one or more representative features of a given embodiment is likewise exemplary. Such an embodiment can typically exist with or without the feature(s) mentioned; likewise, those features can be applied to other embodiments of the presently disclosed subject matter, whether listed in this Summary or not. To avoid excessive repetition, this Summary does not list or suggest all possible combinations of such features.

In some embodiments, the presently disclosed subject matter provides ADAM10 modulating peptides. In some embodiments, the ADAM10 modulating peptides comprise, consist essentially of, or consist of an amino acid sequence comprising at least one amino acid substitution of at least one furin recognition site of SEQ ID NO: 1 or SEQ ID NO: 2 and optionally further comprises at least one amino acid substitution of at least one meprin recognition site of SEQ ID NO: 1 or SEQ ID NO: 2, and combinations thereof, such that the ADAM10 modulating peptide is less sensitive to cleavage by furin and optionally by both furin and meprin. In some embodiments, the at least one furin recognition site is selected from the group consisting of amino acid positions 26-29 and amino acid positions 52-55 of SEQ ID NOs: 1 or SEQ ID NO: 2; and the at least one meprin recognition site is selected from the group consisting of amino acid positions 34-36, amino acid positions 62/63, amino acid positions 88/89, amino acid positions 136-138, amino acid positions 169/170, and amino acid positions 176-178 of SEQ ID NO: 1; or amino acid positions 34-36, amino acid positions 62/63, amino acid positions 88/89, amino acid positions 136-138, and amino acid positions 169/170 of SEQ ID NO: 2. In some embodiments, cysteine 151 of SEQ ID NO: 1 or SEQ ID NO: 2 is substituted with alanine, serine, glycine, or threonine, or is pegylated. In some embodiments, the ADAM10 modulating peptide comprises, consists essentially of, or consists of an amino acid sequence as set forth in either of SEQ ID NOs: 3 and 4. In some embodiments, the ADAM10 modulating peptide comprises, consists essentially of, or consists of an amino acid sequence that comprises an alanine at one or more of positions 26, 28 and 29 of SEQ ID NO: 3 or SEQ ID NO: 4, an alanine at one or more of positions 52, 54 and 55 of SEQ ID NO: 3 or SEQ ID NO: 4, or any combination thereof; and an alanine at one or both of positions 88 and 89, an alanine at one or more of positions 176-178 of SEQ ID NO: 3, or any combination thereof. In some embodiments, cysteine 151 of SEQ ID NO: 3 or SEQ ID NO: 4 is substituted with alanine, serine, glycine, or threonine, or is pegylated. In some embodiments, the ADAM10 modulating peptide comprises, consists essentially of, or consists of an amino acid sequence that comprises an alanine at one or more of positions 26, 28 or 29 of SEQ ID NO: 3 or SEQ ID NO: 4, an alanine at one or more of positions 52, 54 or 55 of SEQ ID NO: 3 or SEQ ID NO: 4, or any combination thereof. In some embodiments and with reference to SEQ ID NO: 3 or SEQ ID NO: 4, one or both of amino acid positions 29 and 55 are independently selected from the group consisting of alanine and lysine. In some embodiments, the ADAM10 modulating peptide further comprises an alanine at one or more of positions 88, 89, 177, and 178 of SEQ ID NO: 3 and/or at positions 88 and 89 of SEQ ID NO: 4, or any combination thereof. In some embodiments, ADAM10 modulating peptide further comprises a modification at the cysteine at amino acid 151 selected from the group consisting of substitution of the cysteine with serine, glycine, alanine, or threonine and pegylation of the cysteine. In some embodiments, amino acid 151 is serine or cysteine 151 is peglyated.

In some embodiments, the ADAM10 modulating peptide further comprises a modification at the cysteine at amino acid 151 selected from the group consisting of substitution of the cysteine with serine, glycine, alanine, or threonine and pegylation of the cysteine. In some embodiments, amino acid 151 is serine and in some embodiments amino acid 151 is pegylated.

In some embodiments and with reference to SEQ ID NO: 3 or SEQ ID NO: 4, one or both of amino acid positions 29 and 55 are independently selected from the group consisting of serine, glycine, and threonine. In some embodiments, amino acid position 151 of SEQ ID NO: 3 or SEQ ID NO: 4 is a serine, glycine, alanine, or threonine. In some embodiments, amino acid position 151 of SEQ ID NO: 3 or SEQ ID NO: 4 is pegylated. In some embodiments, the N-terminus, the C-terminus, or both are pegylated.

In some embodiments and with reference to SEQ ID NO: 3 or SEQ ID NO: 4, amino acid position 26 is not arginine, amino acid position 27 is not alanine, amino acid position 28 is not lysine, and/or amino acid position 29 is not arginine; and/or amino acid position 52 is not arginine, amino acid position 53 is not methionine, amino acid position 54 is not lysine, and/or amino acid position 55 is not arginine; and/or amino acid position 34 is not glutamic acid, amino acid position 35 is not aspartic acid, and/or amino acid position 36 is not glutamine; amino acid position 62 is not aspartic acid and/or amino acid position 63 is not glutamic acid; and/or amino acid position 88 is selected from the group consisting of alanine, serine, glycine, threonine, and asparagine and/or amino acid position 89 is selected from the group consisting of alanine, serine, glycine, threonine, and asparagine; and/or amino acid position 136 is not glutamic acid, amino acid position 137 is not aspartic acid, and/or amino acid position 138 is not aspartic acid; and/or amino acid position 151 is not cysteine; and/or amino acid position 169 is not glutamic acid and/or amino acid position 170 is not glutamic acid; and/or amino acid positions 176-178 of SEQ ID NO: 3 are each independently selected from the group consisting of glutamine, alanine, serine, glycine, threonine, and asparagine, provided that the amino acid sequence at positions 176-178 is not glutamine/glutamic acid/glutamic acid. In some embodiments, the amino acid at position 151 is selected from the group consisting of serine, glycine, alanine, and threonine. In some embodiments, the N-terminus, the C-terminus, the cysteine at position 151, or any combination thereof is pegylated.

In some embodiments, the ADAM10 modulating peptide comprises, consists essentially of, or consists of one or more modifications that inactivate a furin recognition site at amino acid positions 26-28 of SEQ ID NOs: 1 or SEQ ID NO: 2, a furin recognition site at amino acid positions 52-54 of SEQ ID NOs: 1 or SEQ ID NO: 2, or both.

In some embodiments, the ADAM10 modulating peptide comprises, consists essentially of, or consists of one or more modifications that inactivate a meprin recognition site at amino acid positions amino acid positions 34-36 of SEQ ID NO: 1 or SEQ ID NO: 2, amino acid positions 62 and 63 of SEQ ID NO: 1 or SEQ ID NO: 2, amino acid positions 88 and 89 of SEQ ID NO: 1 or SEQ ID NO: 2, amino acid positions 136-138 of SEQ ID NO: 1 or SEQ ID NO: 2, amino acid positions 169 and 170 of SEQ ID NO: 1 or SEQ ID NO: 2, amino acid positions 176-178 of SEQ ID NO: 1, or any combination thereof.

In some embodiments, the ADAM10 modulating peptide comprises, consists essentially of, or consists of at least two modifications that inactivate the meprin recognition site at amino acid positions 88 and 89 of SEQ ID NO: 1 and amino acid positions 176-178 of SEQ ID NO: 1.

In some embodiments, the ADAM10 modulating peptide comprises, consists essentially of, or consists of a plurality of modifications that inactivate the furin recognition sites at amino acid positions 26-28 and 52-54 of SEQ ID NOs: 1 or SEQ ID NO: 2; and the meprin recognition sites at amino acid positions 34-36, 62 and 63, 88 and 89, 136-138, and 169 and 170 of SEQ ID NO: 1 or SEQ ID NO: 2; and optionally further inactivate the meprin recognition site at amino acid positions 176-178 of SEQ ID NO: 1.

In some embodiments, the ADAM10 modulating peptide comprises, consists essentially of, or consists of a plurality of modifications that inactivate the furin recognition sites at amino acid positions 26-28 and 52-54 of SEQ ID NOs: 1 or SEQ ID NO: 2; and the meprin recognition sites at amino acid positions 88 and 89 and 176-178 of SEQ ID NO: 1.

In some embodiments, the ADAM10 modulating peptide comprises, consists essentially of, or consists of an amino acid sequence that with reference to SEQ ID NO: 1, comprises amino acid substitutions as defined in SEQ ID NO: 3 at one or more of amino acid positions 26-29; and one or more of amino acid positions 52-55; and amino acid positions 88/89; and amino acid positions 176-178. In some embodiments, amino acid position 151 is selected from the group consisting of serine, glycine, alanine, and threonine or the cysteine at amino acid position 151 is pegylated. In some embodiments, the ADAM10 modulating peptide further comprises a PEG moiety at the N-terminus, the C-terminus, amino acid position 151, or any combination thereof. In some embodiments, the ADAM10 modulating peptide further comprises a PEG moiety at the N-terminus, the C-terminus, amino acid position 151, or any combination thereof.

In some embodiments, the ADAM10 modulating peptide further comprises one or more amino acid substitutions as defined in SEQ ID NO: 3 at one or more of the meprin recognition sites at amino acid positions 34-36, 62/63, 136-138, and 169/170 of SEQ ID NO: 1 or SEQ ID NO: 2 and optionally 176-178 of SEQ ID NO: 1. In some embodiments, at least one of the amino acid substitutions is an alanine substitution. In some embodiments, the ADAM10 modulating peptide further comprises a PEG moiety at the N-terminus, the C-terminus, amino acid position 151, or any combination thereof. In some embodiments, the ADAM10 modulating peptide further comprises a PEG moiety at the N-terminus, the C-terminus, amino acid position 151, or any combination thereof.

In some embodiments, the ADAM10 modulating peptide comprises an amino acid sequence as set forth in any of SEQ ID NOs: 5-71,814. In some embodiments and with reference to SEQ ID NO: 1, each of amino acid positions 29 and 55 are substituted with conservative amino acid changes serine, glycine, threonine or serine; at least one of each of amino acid positions 34-36 are substituted are substituted with conservative amino acid changes asparagine, serine, glycine, threonine or serine; at least one of amino acid positions 62 and 63 are substituted with conservative amino acid changes asparagine, serine, glycine, threonine or serine; at least one of amino acid positions 88 and 89 are substituted with conservative amino acid changes asparagine, serine, glycine, threonine or serine; at least one of amino acid positions 136-138 are substituted are substituted with conservative amino acid changes asparagine, serine, glycine, threonine or serine; at least one of amino acid positions 169 and 170 are substituted are substituted with conservative amino acid changes asparagine, serine, glycine, threonine or serine; at least one of amino acid positions 176-178 are substituted with conservative amino acid changes asparagine, serine, glycine, threonine or serine. In some embodiments, the ADAM10 modulating peptide further comprises a PEG moiety at the N-terminus, the C-terminus, amino acid position 151 of SEQ ID NO: 1, or any combination thereof.

In some embodiments, the ADAM10 modulating peptide comprises an amino acid sequence at least 87%, 88%, 89%, 90%, 91%, 92%, 93%, 94%, 95%, 96%, 97%, 98%, or 99% identical to any of SEQ ID NOs: 5-71,814. In some embodiments, the amino acid sequence comprises one or more amino acid substitutions of SEQ ID NOs: 5-6,281 at an amino acid position selected from the group consisting of amino acid positions 26, 28, 29, 34-36, 52, 54, 55, 62, 63, 88, 89, 136-138, 151, 169-178, 182, and 183 as defined in SEQ ID NO: 3 for these amino acid positions. In some embodiments, amino acid position 151 is selected from the group consisting of serine, glycine, alanine, and threonine or the cysteine at amino acid position 151 is pegylated. In some embodiments and with reference to SEQ ID NO: 1, at least one of amino acids 26, 28 and 29 and/or at least one of amino acids 52, 54 and 55 are substituted are substituted with conservative amino acid changes serine, glycine, threonine or serine; and at least one amino acids of position 88/89 and/or 176-178 are substituted with conservative amino acid changes asparagine, serine, glycine, threonine or serine. In some embodiments, the ADAM10 modulating peptide further comprises a PEG moiety at the N-terminus, the C-terminus, amino acid position 151 of SEQ ID NO: 1, or any combination thereof.

The presently disclosed subject matter also provides in some embodiments ADAM10 modulating peptides comprising, consisting essentially of, or consisting of SEQ ID NO: 1 or SEQ ID NO: 2 conjugated to a PEG moiety. In some embodiments, the PEG moiety is conjugated to the cysteine at amino acid position 151 of SEQ ID NO: 1 or SEQ ID NO: 2.

The presently disclosed subject matter also provides in some embodiments ADAM10 modulating peptides comprising, consisting essentially of, or consisting of an amino acid sequence as set forth in any one of SEQ ID NOs: 5, 6, 9, 34, 36, and 62-71. In some embodiments, the peptide comprises, consists essentially of, or consists of an amino acid sequence as set forth in SEQ ID NO: 62 or SEQ ID NO: 63.

The presently disclosed subject matter also provides in some embodiments ADAM10 modulating peptides comprising, consisting essentially of, or consisting of an amino acid sequence that is at least 87%, 88%, 89%, 90%, 91%, 92%, 93%, 94%, 95%, 96%, 97%, 98%, or 99% identical to any one of SEQ ID NOs: 5, 6, 9, 34, 36, and 62-71. In some embodiments, the amino acid sequence is at least 87%, 88%, 89%, 90%, 91%, 92%, 93%, 94%, 95%, 96%, 97%, 98%, or 99% identical to SEQ ID NO: 62 or SEQ ID NO: 63.

The presently disclosed subject matter also provides in some embodiments ADAM10 modulating peptides comprising, consisting essentially of, or consisting of an amino acid sequence that is at least 87%, 88%, 89%, 90%, 91%, 92%, 93%, 94%, 95%, 96%, 97%, 98%, or 99% identical to SEQ ID NO: 3 of SEQ ID NO: 4. In some embodiments, as compared to SEQ ID NO: 3, the amino acid sequence comprises one or more conservative amino acid substitutions at one or more positions selected from the group consisting of positions 39, 48, 73, 107, 115, 126, 135, 171-175, 182, and 183 of SEQ ID NO: 3 or the corresponding positions in SEQ ID NO: 4. In some embodiments, as compared to SEQ ID NO: 3, the amino acid sequence comprises a leucine substitution at amino acid position 39, an alanine substitution at amino acid position 48, a proline substitution at amino acid position 73, a lysine substitution at amino acid position 107, an isoleucine substitution at amino acid position 115, an isoleucine substitution at amino acid position 126, or any combination thereof. In some embodiments, as compared to SEQ ID NO: 3, the amino acid sequence is selected from the group consisting of SEQ ID NOs: 64-66. In some embodiments, the amino acid sequence comprises at least one introduction of a cysteine into any one of SEQ ID NOs: 5, 6, 9, 34, 36, and 62-71 internally, at the N-terminus, at the C-terminus, or any combination thereof, and further wherein the at least one introduced cysteine results from a substitution of one or more amino acids of SEQ ID NOs: 5, 6, 9, 34, 36, and 62-71, an insertion of a cysteine into any one of SEQ ID NOs: 5, 6, 9, 34, 36, and 62-71, or any combination thereof. In some embodiments, the introduced cysteine is pegylated. In some embodiments, the pegylated introduced cysteine is located within the first 20 amino acids of any one of SEQ ID NOs: 5, 6, 9, 34, 36, and 62-71; within the last 20 amino acids of any one of SEQ ID NOs: 5, 6, 9, 34, 36, and 62-71.

In some embodiments, the amino acid sequence comprises at least one introduction of a cysteine into any one of SEQ ID NOs: 5-6,281 internally, at the N-terminus, at the C-terminus, or any combination thereof, and further wherein the at least one introduced cysteine results from a substitution of one or more amino acids of SEQ ID Nos: 5-6281, or any combination thereof. In some embodiments, the introduced cysteine is pegylated. In some embodiments, the pegylated introduced cysteine is located within the first 20 amino acids of any one of SEQ ID NOs: 5-6,281; within the last 20 amino acids of any one of SEQ ID NOs: 5-6281.

In some embodiments, the amino acid sequence comprises at least one introduction of a cysteine into any one of SEQ ID NOs: 6,282-71,814 internally, at the N-terminus, at the C-terminus, or any combination thereof, and further wherein the at least one introduced cysteine results from a substitution of one or more amino acids of SEQ ID Nos: 6,282-71,814, or any combination thereof. In some embodiments, the introduced cysteine is pegylated. In some embodiments, the pegylated introduced cysteine is located within the first 20 amino acids of any one of SEQ ID NOs: 6,282-71,814; within the last 20 amino acids of any one of SEQ ID NOs: 5-6281.

In some embodiments, the amino acid sequence comprises at least one introduction of a cysteine into any one of SEQ ID NOs: 3 and 4 internally, at the N-terminus, at the C-terminus, or any combination thereof, and further wherein the at least one introduced cysteine results from a substitution of one or more amino acids of SEQ ID Nos: 3 and 4, or any combination thereof. In some embodiments, the introduced cysteine is pegylated. In some embodiments, the pegylated introduced cysteine is located within the first 20 amino acids of any one of SEQ ID NOs: 3 and 4; within the last 20 amino acids of any one of SEQ ID NOs: 3 and 4.

In some embodiments of the ADAM10 modulating peptides of the presently disclosed subject matter, the ADAM10 modulating peptide comprises one or more modifications selected from the group consisting of conservative amino acid substitutions, non-natural amino acid substitutions, D- or D,L-racemic mixture isomer form amino acid substitutions, amino acid chemical substitutions, carboxy- or amino-terminal modifications, addition of one or more glycosyl groups, and conjugation to a molecule selected from the group consisting of a fatty acid, a PEG, a sugar, a fluorescent molecule, a chromophore, a radionuclide, a bioconjugate, a tag that can be employed for purification and/or isolation of the ADAM10 modulating peptide, and an antibody or a paratope-containing fragment or derivative thereof.

The presently disclosed subject matter also provides ADAM10 modulating peptides comprising, consisting essentially of, or consisting of an amino acid sequence selected from the group consisting of (i) an amino acid sequence that is at least 87%, 88%, 89%, 90%, 91%, 92%, 93%, 94%, 95%, 96%, 97%, 98%, or 99% identical to SEQ ID NO: 3 or SEQ ID NO: 4; (ii) an amino acid sequence that is at least 87%, 88%, 89%, 90%, 91%, 92%, 93%, 94%, 95%, 96%, 97%, 98%, or 99% identical to SEQ ID NO: 1 or SEQ ID NO: 2 that comprises at least one amino acid substitution at one or more of amino acid positions 26-29, 34-36, 52-55, 62/63, 88/89, 136-138, and 169/170 of SEQ ID NO: 1 or SEQ ID NO: 2 and/or amino acid positions 176-178 of SEQ ID NO: 1; (iii) an amino acid sequence of (i) or (ii) above that is pegylated at or near the N-terminus, at or near the C-terminus, at Cys151 of SEQ ID NO: 1 or 2, or any combination thereof; and (iv) an amino acid sequence as set forth in SEQ ID NO: 1 or SEQ ID NO: 2, wherein the amino acid sequence is pegylated at or near the N-terminus, at or near the C-terminus, at Cys151 of SEQ ID NO: 1 or 2, or any combination thereof.

The presently disclosed subject matter also provides in some embodiments compositions comprising one or more ADAM10 modulating peptides as disclosed herein.

The presently disclosed subject matter also provides in some embodiments pharmaceutical compositions comprising one or more ADAM10 modulating peptides as disclosed herein and a pharmaceutically acceptable carrier or excipient. In some embodiments, the pharmaceutically composition is pharmaceutically acceptable for use in a human.

The presently disclosed subject matter also provides in some embodiments polypeptides comprising, consisting essentially of, or consisting of an amino acid sequence as set forth in any of SEQ ID NOs: 5-71,814. In some embodiments, the polypeptide is pegylated.

The presently disclosed subject matter also provides in some embodiments polypeptides comprising, consisting essentially of, or consisting of an amino acid sequence as set forth in any of SEQ ID NOs: 5-6,281. In some embodiments, wherein the polypeptide is pegylated. In some embodiments, the polypeptide further comprises a tag, optionally a His tag or any other peptide or non-peptide tag that can be employed for purification and/or isolation of the polypeptide. In some embodiments, the tag is releasable from the polypeptide by proteolytic cleavage.

In some embodiments, the polypeptide is adapted for in vitro use. In some embodiments, the polypeptide is adapted for in vivo use.

The presently disclosed subject matter also provides in some embodiments polypeptides comprising, consisting essentially of, or consisting of SEQ ID NO: 1 or SEQ ID NO: 2, wherein at least one meprin cleavage site and at least one furin cleavage site comprises an amino acid substitution as set forth in SEQ ID NO: 3 or SEQ ID NO: 4 that renders the polypeptide less susceptible to cleavage by meprin and by furin. In some embodiments, the polypeptide is pegylated. In some embodiments, cysteine 151 is conjugated to one or more moieties selected from the group consisting of a moiety that improves potency, solubility, or a pharmacokinetic property of the polypeptide relative to a wild type ADAM10 polypeptide; a chromophore; a fluorophore; and a radionucleotide; wherein the one or more moieties facilitates study of a pharmacokinetic and/or a pharmacodynamic property of the polypeptide.

The presently disclosed subject matter also provides in some embodiments polypeptides comprising, consisting essentially of, or consisting of an amino acid sequence as set forth in one of SEQ ID NOs: 6282-71,814, wherein the polypeptides further comprise a spacer containing one or more charged residues selected from the group consisting of Asp, Glu, Arg, and Lys added at the N-terminus, the C-terminus, or both, and further wherein presence of the added one or more charged residues results in improved solubility of the polypeptide as compared to the polypeptide lacking the added one or more charged residues.

The presently disclosed subject matter also provides in some embodiments polypeptides comprising, consisting essentially of, or consisting of an amino acid sequence as set forth in one of SEQ ID NOs: 5-6,281, wherein the polypeptides further comprise a spacer containing one or more charged residues selected from the group consisting of Asp, Glu, Arg, and Lys added at the N-terminus, the C-terminus, or both, and further wherein presence of the added one or more charged residues results in improved solubility of the polypeptide as compared to the polypeptide lacking the added one or more charged residues.

The presently disclosed subject matter also provides in some embodiments methods for modulating ADAM10 biological activities in vitro, ex vivo, or in vivo. In some embodiments, the methods comprising contacting a solution or a cell comprising an ADAM10 polypeptide with one or more ADAM10 modulating peptides as disclosed herein or a composition as disclosed herein, wherein the contacting comprises contacting the ADAM10 polypeptide with an amount of the ADAM10 modulating peptide sufficient to modulate a biological activity of the ADAM10 polypeptide.

The presently disclosed subject matter also provides in some embodiments methods for inhibiting ADAM10 biological activities in vivo. In some embodiments, the methods comprise administering to a subject a composition comprising, consisting essentially of, or consisting of one or more ADAM10 modulating peptides as disclosed herein via a route and in an amount sufficient to inhibit a biological activity of an ADAM10 polypeptide in the subject. In some embodiments, the ADAM10 modulating peptide is pegylated.

The presently disclosed subject matter also provides in some embodiments methods for inhibiting ADAM10 biological activities associated with a disease, disorder, or condition in a subject. In some embodiments, the methods comprise contacting an ADAM10 polypeptide present in a subject with an effective amount of one or more ADAM10 modulating peptides as disclosed herein, wherein the disease, disorder, or condition is selected from the group consisting of cancer, inflammation, an allergic response, lupus, asthma, an infectious disease, and fibrosis, and further wherein the subject has the disease, disorder, or condition or is predisposed thereto. In some embodiments, the disease, disorder, or condition results at least in part from excess cell proliferation associated with an ADAM10 biological activity. In some embodiments, the disease, disorder, or condition is characterized at least in part by presence of an excess of ADAM10 biological activity or protein.

The presently disclosed subject matter also provides in some embodiments methods for inhibiting release of an ADAM10 substrate from a cell. In some embodiments, the methods comprise contacting the cell with one or more ADAM10 modulating peptides as disclosed herein in an amount sufficient to inhibit release of the ADAM10 substrate from the cell. In some embodiments, the ADAM10 substrate is selected from the group consisting of CD23, IL6-R, EGF, Her-2, HB-EGF, betacellulin, jagged-1, Notch receptor 1, Notch receptor 3, RAGE, fractalkine, MICA A, I-TAC, HGFR, GITR, GM-CSF, an IGF soluble receptors, and TGF beta. In some embodiments, the cell is present in or has been isolated from a subject.

Thus, it is an object of the presently disclosed subject matter to provide ADAM10 modulating peptides that comprise modifications at one or more furin sites and/or one or more meprin sites such that the modified ADAM10 peptides are more resistant to cleavage by furin and/or meprin as compared to an identical peptide lacking the modifications.

An object of the presently disclosed subject matter having been stated above, other objects and advantages will become apparent upon a review of the following Detailed Description and Examples, particularly in view of the Figures.

BRIEF DESCRIPTION OF THE FIGURES

FIG. 6A is a bar graph showing serum levels (in µM) of modified ADAM10 peptides. FIG. 6B is a bar graph showing serum levels (in nM) of modified ADAM10 peptides. FIG. 6C is a bar graph showing serum concentrations (in nM) of modified ADAM10 peptides. FIG. 6D is a bar graph showing serum concentrations (in nM) of modified ADAM10 peptides.

FIG. 8A shows the result of testing SEQ ID NOs: 62, 63, 34, and a pegylated version of SEQ ID NO: 71 at 3, 10, 20, and 120 minutes after adding furin. FIG. 8B shows the result of testing SEQ ID NOs: 62, 65, and 68 at 0, 20, 40, and 120 minutes after adding furin. FIG. 8C shows the result of testing SEQ ID NOs: 63 and pegylated versions of SEQ ID NOs: 69, 70, and 71 at 0, 30, and 120 minutes after adding furin.

FIG. 9A shows the result of testing SEQ ID NOs: 5, 62, 63, and 34 at 0 and 10 minutes after adding meprin. FIG. 9B shows the result of testing SEQ ID NOs: 34, 66, 67, and 68 at 0 and 17 minutes after adding meprin. FIG. 9C shows the result of testing SEQ ID NOs: 63 and pegylated versions of SEQ ID NOs: 69 (69P), 70 (70P), and 71 (71P) at 2 and 10 minutes after adding meprin.

REFERENCE TO SEQUENCE LISTING SUBMITTED ON COMPACT DISC

Figure 1:
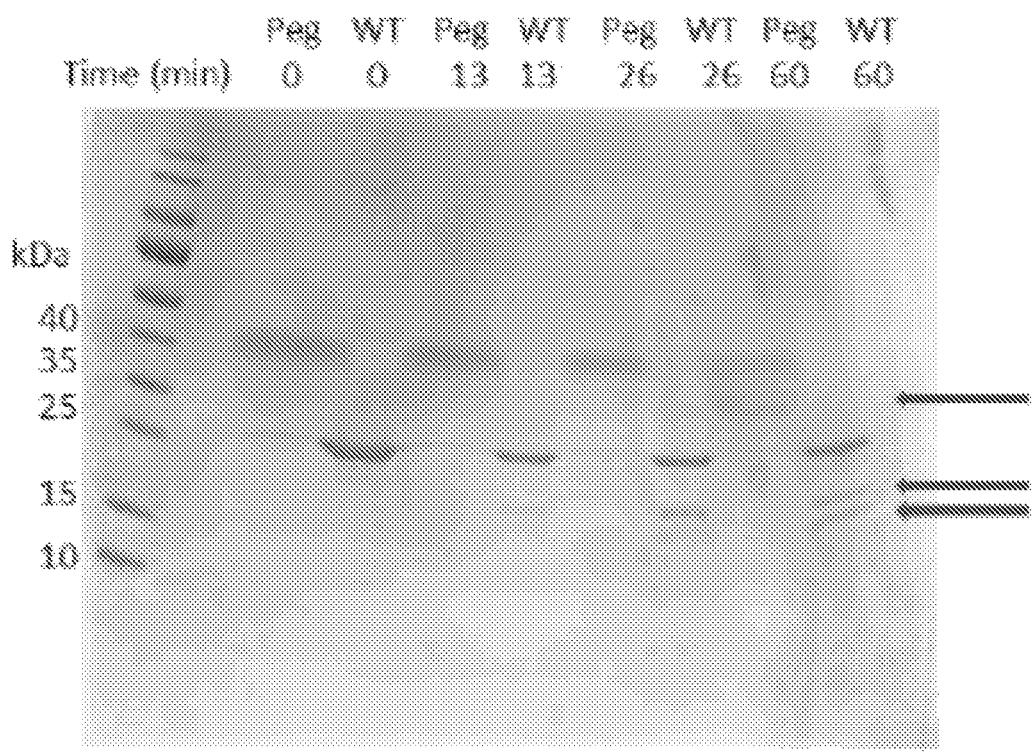
FIG. 1 is a image of a Coomassie-stained SDS-PAGE gel showing the results of furin cleavage of C-terminal His-tagged wild type (WT) and pegylated (Peg) human ADAM10 peptides corresponding to amino acids 23-211 of the wild type human ADAM10 prodomain (i.e., SEQ ID NO: 1) at 0, 13, 26, and 60 minutes. The left-most lane shows the positions of various molecular weight markers. The uncleaved peptide migrated at about 25 kiloDaltons (kDa) and its position can be seen between the top and the middle arrows on the right of the Figure. The arrows on the right side of the Figure show the positions of the cleaved pegylated peptide (top arrow), the 19.7 kDa product produced by cleavage between amino acids 51 and 52 of the non-pegylated wild type human ADAM10 prodomain (i.e., between amino acids 29 and 30 of SEQ ID NO: 1; middle arrow), and 16.5 kDa product produced by cleavage between amino acids 77 and 78 of the non-pegylated wild type human ADAM10 prodomain (i.e., between amino acids 55 and 56 of SEQ ID NO: 1; lower arrow) after cleavage and recovery of the C-terminal cleavage products using an Ni-NTA resin to bind the His tag. It is noted that since the N-terminus was not tagged, only one cleavage product was recovered per cleavage reaction. The pegylated (Peg) human ADAM10 peptides corresponding to amino acids 23-211 of the wild type human ADAM10 prodomain (i.e., SEQ ID NO: 1) in lanes 2, 4, 6, and 8 migrated at about 40 kDa due to the presence of the 10 kDa PEG moiety.

The Sequence Listing associated with the instant disclosure has been submitted as a 123.3 MB file on a compact disc. The compact disc is marked in indelible ink to identify the Applicants, Title, File Name (FINAL_3217-2-2_ST25.txt), Creation Date (Oct. 2, 2018), Computer System (IBM-PC/MS-DOS/MS-Windows), and the Serial No. of the corresponding U.S. utility application U.S. patent application Ser. No. 16/149,764. The Sequence Listing submitted on compact disc is hereby incorporated by reference into the instant disclosure.

BRIEF DESCRIPTION OF THE SEQUENCE LISTING

SEQ ID NO: 1 is the amino acid sequence of a wild type human ADAM10 prodomain peptide. It corresponds to amino acids 23-211 of Accession No. NP_001101.1 of the GENBANK® biosequence database SEQ ID NO: 2 is the amino acid sequence of a wild type murine ADAM10 prodomain peptide. It corresponds to amino acids 23-212 of Accession No. NP_031425.2 of the GENBANK® biosequence database.

SEQ ID NO: 3 is a consensus amino acid sequence for the ADAM10 modulating peptides of the presently disclosed subject matter that are based on SEQ ID NO: 1. As compared to SEQ ID NO: 1, SEQ ID NO: 3 includes 24 amino acid positions that can be substituted individually or in any combination or subcombination. The 24 amino acid positions correspond to two (2) furin recognition sites, six (6) meprin recognition sites, and the single cysteine present in SEQ ID NO: 1 at position 151.

SEQ ID NO: 4 is a consensus amino acid sequence for the ADAM10 modulating peptides of the presently disclosed subject matter that are based on SEQ ID NO: 2. As compared to SEQ ID NO: 2, SEQ ID NO: 4 includes 21 amino acid positions that can be substituted individually or in any combination or subcombination. The 21 amino acid positions correspond to two (2) furin recognition sites, five (5) meprin recognition sites, and the single cysteine present in SEQ ID NO: 2 at position 151.

SEQ ID NOs: 5-71,814 are the amino acid sequences of exemplary ADAM10 modulating peptides of the presently disclosed subject matter that correspond to embodiments of SEQ ID NO: 3 or SEQ ID NO: 4.

DETAILED DESCRIPTION

The presently disclosed subject matter now will be described more fully hereinafter, in which some, but not all embodiments of the presently disclosed subject matter are described. Indeed, the presently disclosed subject matter can be embodied in many different forms and should not be construed as limited to the embodiments set forth herein; rather, these embodiments are provided so that this disclosure will satisfy applicable legal requirements.

I. Definitions

The terminology used herein is for the purpose of describing particular embodiments only and is not intended to be limiting of the presently disclosed subject matter.

While the following terms are believed to be well understood by one of ordinary skill in the art, the following definitions are set forth to facilitate explanation of the presently disclosed subject matter.

All technical and scientific terms used herein, unless otherwise defined below, are intended to have the same meaning as commonly understood by one of ordinary skill in the art. References to techniques employed herein are intended to refer to the techniques as commonly understood in the art, including variations on those techniques or substitutions of equivalent techniques that would be apparent to one of skill in the art. While the following terms are believed to be well understood by one of ordinary skill in the art, the following definitions are set forth to facilitate explanation of the presently disclosed subject matter.

In describing the presently disclosed subject matter, it will be understood that a number of techniques and steps are disclosed. Each of these has individual benefit and each can also be used in conjunction with one or more, or in some cases all, of the other disclosed techniques.

Accordingly, for the sake of clarity, this description will refrain from repeating every possible combination of the individual steps in an unnecessary fashion. Nevertheless, the specification and claims should be read with the understanding that such combinations are entirely within the scope of the invention and the claims.

Following long-standing patent law convention, the terms "a", "an", and "the" refer to "one or more" when used in this application, including the claims. For example, the phrase "an antibody" refers to one or more antibodies, including a plurality of the same antibody. Similarly, the phrase "at least one", when employed herein to refer to an entity, refers to, for example, 1, 2, 3, 4, 5, 6, 7, 8, 9, 10, 15, 20, 25, 30, 35, 40, 45, 50, 75, 100, or more of that entity, including but not limited to whole number values between 1 and 100 and greater than 100.

Unless otherwise indicated, all numbers expressing quantities of ingredients, reaction conditions, and so forth used in the specification and claims are to be understood as being modified in all instances by the term "about". The term "about", as used herein when referring to a measurable value such as an amount of mass, weight, time, volume, concentration or percentage is meant to encompass variations of in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed methods. Accordingly, unless indicated to the contrary, the numerical parameters set forth in this specification and attached claims are approximations that can vary depending upon the desired properties sought to be obtained by the presently disclosed subject matter.

As used herein, the term "amino acid" refers to α-amino acids that can be employed in producing the ADAM10 modulating peptides of the presently disclosed subject matter. There are twenty "standard" amino acids that naturally occur in polypeptides, and these are summarized in Table 1.

TABLE 1

Amino Acid Abbreviations, Codes, and Functionally Equivalent Codons

| Amino Acid | 3-Letter Code | 1-Letter Code |
|---|---|---|
| Alanine | Ala | A |
| Arginine | Arg | R |
| Asparagine | Asn | N |
| Aspartic Acid | Asp | D |
| Cysteine | Cys | C |
| Glutamic acid | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

As used herein, the term "and/or" when used in the context of a list of entities, refers to the entities being present singly or in combination. Thus, for example, the phrase "A, B, C, and/or D" includes A, B, C, and D individually, but also includes any and all combinations and subcombinations of A, B, C, and D.

The term "comprising", which is synonymous with "including" "containing", or "characterized by", is inclusive or open-ended and does not exclude additional, unrecited elements and/or method steps. "Comprising" is a term of art that means that the named elements and/or steps are present, but that other elements and/or steps can be added and still fall within the scope of the relevant subject matter.

As used herein, the phrase "consisting of" excludes any element, step, or ingredient not specifically recited. It is noted that, when the phrase "consists of" appears in a clause of the body of a claim, rather than immediately following the preamble, it limits only the element set forth in that clause; other elements are not excluded from the claim as a whole.

As used herein, the phrase "consisting essentially of" limits the scope of the related disclosure or claim to the specified materials and/or steps, plus those that do not materially affect the basic and novel characteristic(s) of the disclosed and/or claimed subject matter. For example, a pharmaceutical composition can "consist essentially of" a pharmaceutically active agent or a plurality of pharmaceutically active agents, which means that the recited pharmaceutically active agent(s) is/are the only pharmaceutically active agent(s) present in the pharmaceutical composition. It is noted, however, that carriers, excipients, and other inactive agents can and likely would be present in the pharmaceutical composition.

With respect to the terms "comprising", "consisting of", and "consisting essentially of", where one of these three terms is used herein, the presently disclosed and claimed subject matter can include the use of either or both of the other two terms. For example, in some embodiments, the presently disclosed subject matter relates to compositions comprising peptides. It would be understood by one of ordinary skill in the art after review of the instant disclosure that the presently disclosed subject matter thus encompasses compositions that consist essentially of the peptides of the presently disclosed subject matter, as well as compositions that consist of the peptides of the presently disclosed subject matter.

The term "subject" as used herein refers to a member of any invertebrate or vertebrate species. Accordingly, the term "subject" is intended to encompass any member of the Kingdom Animalia including, but not limited to the phylum Chordata (e.g., members of Classes Osteichythyes (bony fish), Amphibia (amphibians), Reptilia (reptiles), Aves (birds), and Mammalia (mammals)), and all Orders and Families encompassed therein.

The compositions and methods of the presently disclosed subject matter are particularly useful for warm-blooded vertebrates. Thus, the presently disclosed subject matter concerns mammals and birds. More particularly provided are compositions and methods derived from and/or for use in mammals such as humans and other primates, as well as those mammals of importance due to being endangered (such as Siberian tigers), of economic importance (animals raised on farms for consumption by humans) and/or social importance (animals kept as pets or in zoos) to humans, for instance, carnivores other than humans (such as cats and dogs), swine (pigs, hogs, and wild boars), ruminants (such as cattle, oxen, sheep, giraffes, deer, goats, bison, and camels), rodents (such as mice, rats, and rabbits), marsupials, and horses. Also provided is the use of the disclosed methods and compositions on birds, including those kinds of birds that are endangered, kept in zoos, as well as fowl, and more particularly domesticated fowl, e.g., poultry, such as turkeys, chickens, ducks, geese, guinea fowl, and the like, as they are also of economic importance to humans. Thus, also provided is the use of the disclosed methods and compositions on livestock, including but not limited to domesticated swine (pigs and hogs), ruminants, horses, poultry, and the like.

Similarly, all genes, gene names, and gene products disclosed herein are intended to correspond to orthologs from any species for which the compositions and methods disclosed herein are applicable. Thus, the terms include, but are not limited to genes and gene products from humans and mice. It is understood that when a gene or gene product from a particular species is disclosed, this disclosure is intended to be exemplary only, and is not to be interpreted as a limitation unless the context in which it appears clearly indicates. Thus, for example, for the genes presented herein, the human amino acid sequences disclosed are intended to encompass homologous genes and gene products from other animals including, but not limited to other mammals, fish, amphibians, reptiles, and birds. Also encompassed are any and all nucleotide sequences that encode the disclosed amino acid sequences, including but not limited to those disclosed in the corresponding GENBANK® biosequence database entries.

The terms "cancer" and "tumor" are used interchangeably herein and can refer to both primary and metastasized solid tumors and carcinomas of any tissue in a subject, including but not limited to breast; colon; rectum; lung; oropharynx; hypopharynx; esophagus; stomach; pancreas; liver; gallbladder; bile ducts; small intestine; urinary tract including kidney, bladder, and urothelium; female genital tract including cervix, uterus, ovaries (e.g., choriocarcinoma and gestational trophoblastic disease); male genital tract including prostate, seminal vesicles, testes and germ cell tumors; endocrine glands including thyroid, adrenal, and pituitary; skin (e.g., hemangiomas and melanomas), bone or soft tissues; blood vessels (e.g., Kaposi's sarcoma); brain, nerves, eyes, and meninges (e.g., astrocytomas, gliomas, glioblastomas, retinoblastomas, neuromas, neuroblastomas, Schwannomas and meningiomas). As used herein, the terms "cancer and "tumor" are also intended to refer to multicellular tumors as well as individual neoplastic or pre-neoplastic cells. In some embodiments, a cancer or a tumor comprises a cancer or tumor of an epithelial tissue such as, but not limited to a carcinoma. In some embodiments, a tumor is an adenocarcinoma, which in some embodiments is an adenocarcinoma of the pancreas, breast, ovary, colon, or rectum, and/or a metastatic cell derived therefrom.

II. ADAM10 Modulating Peptides and Conjugates Thereof, Compositions, Pharmaceutical Compositions, and Polypeptides II.A. ADAM10 Modulating Peptides, Polypeptides, and Conjugates Thereof ADAM10 biological activity has been implicated in diseases such as cancer, neurological disorders, asthma, and allergic responses, and disorders characterized at least in part by the presence of one or more of inflammation, excess cell proliferation, angiogenesis, and excess soluble CD23. Generally, ADAM family members including ADAM10 are expressed as zymogens with the prodomains maintaining the enzymes in a latent state. In some embodiments, the ADAM10 modulating peptides of the presently disclosed subject matter are based on ADAM10 prodomain sequences but have one or more modifications as compared to the wild type ADAM10 prodomain sequence upon which they are based that result in increased stability and ADAM10 inhibitory activity.

More particularly, SEQ ID NO: 1 corresponds to amino acids 23-211 of the human ADAM10 polypeptide (i.e., represents the wild type human ADAM10 prodomain), and SEQ ID NO: 2 corresponds to amino acids 23-212 of the murine ADAM10 polypeptide. Thus, in some embodiments the ADAM10 modulating peptides of the presently disclosed subject matter have amino acid sequences with one or more modifications as compared to SEQ ID NO: 1 or SEQ ID NO: 2. It has been determined that within SEQ ID NO: 1 there are two furin recognition sequences and six meprin recognition sequences, and that SEQ ID NO: 2 includes both of the furin recognition sequences and the first five meprin recognition sequences of SEQID NO: 1.

It has been further determined that modifying one or more of the furin recognition sequences, optionally in conjunction with modifications of one or more of the meprin recognition sequences, results in reduced sensitivity of the ADAM10 modulating peptides of the presently disclosed subject matter to cleavage by furin and/or meprin. This reduced sensitivity to cleavage by furin and/or meprin results in an enhanced stability of the ADAM10 modulating peptides of the presently disclosed subject matter, which also leads to an increased ability of the ADAM10 modulating peptides of the presently disclosed subject matter to inhibit the biological activity of ADAM10 polypeptides.

With reference to SEQ ID NO: 1, the first (i.e., N-terminal) furin recognition sequence corresponds to amino acids 26-29 of SEQ ID NO: 1, and the second (i.e., C-terminal) furin recognition sequence corresponds to amino acids 52-55 of SEQ ID NO: 1. It has been determined that modifications the amino acid sequence of SEQ ID NO: 1 at one or more of amino acids 26-29 and/or amino acids 52-55 can reduce the ability of furin to cleave the ADAM10 modulating peptides of the presently disclosed subject matter.

Therefore, in some embodiments the presently disclosed subject matter provides ADAM10 modulating peptides, wherein the ADAM10 modulating peptide comprises, consists essentially of, or consists of an amino acid sequence comprising at least one amino acid substitution of at least one furin recognition site such as but not limited to amino acids 26-29 and/or amino acids 52-55 of SEQ ID NO: 1, wherein the at least one amino acid substitution of at least one furin recognition site renders the ADAM10 modulating peptide less sensitive to cleavage by furin. Exemplary, non-limiting amino acid modifications to the furin recognition sites are presented in Table 2:

TABLE 2

Exemplary Amino Acid Substitutions at the Furin Recognition Sites of SEQ ID NO: 1

| SEQ ID NO: 1 Amino Acid | Wild Type Amino Acid | Exemplary Substitutions |
|---|---|---|
| Furin Recognition Site A | | |
| 26 | Arg | Ala, Ser, Gly, Thr, or Lys |
| 27 | Ala | Arg or Lys, but only if the amino acid at position 26 is mutated to Ala, Ser, Gly, or Thr |
| 28 | Lys | Ala, Ser, Gly, or Thr; or Arg if the amino acid at position 29 is Lys |
| 29 | Arg | Ala, Ser, Gly, Thr, or Lys |
| Furin Recognition Site B | | |
| 52 | Arg | Ala, Ser, Gly, Thr, or Lys |
| 53 | Met | Arg or Lys, but only if the amino acid at position 52 is mutated to Ala, Ser, Gly, or Thr |
| 54 | Lys | Ala, Ser, Gly, or Thr |
| 55 | Arg | Ala, Ser, Gly, Thr, or Lys |

It is noted that with respect to amino acid positions 26-29 and 52-54, one, two, three, four, five, six, seven, or all eight amino acid positions can be modified in order to enhance the stability of the ADAM10 modulating peptides of the presently disclosed subject matter, and that in some embodiments at each of these positions any of the amino acid substitutions listed in Table 2 can be employed.

Furthermore and with respect to the meprin recognition sites, in some embodiments the presently disclosed subject matter provides ADAM10 modulating peptides wherein the ADAM10 modulating peptides comprise, consist essentially of, or consist of an amino acid sequence comprising at least one amino acid substitution of at least one meprin recognition site of SEQ ID NO: 1 or SEQ ID NO: 2, wherein the at least one amino acid substitution of at least one meprin recognition site renders the ADAM10 modulating peptide less sensitive to cleavage by meprin. Exemplary, non-limiting amino acid modifications to the meprin recognition sites are presented in Table 3.

TABLE 3

Exemplary Amino Acid Substitutions at the Furin Recognition Sites of SEQ ID NO: 1

| SEQ ID NO: 1 Amino Acid | Wild Type Amino Acid | Exemplary Substitutions |
|---|---|---|
| Meprin Recognition Site A | | |
| 34 | Glu | Ala, Ser, Gly, Thr, or Asn |
| 35 | Asp | Ala, Ser, Gly, Thr, or Asn |
| 36 | Gln | Ala, Ser, Gly, Thr, or Asn |
| Meprin Recognition Site B | | |
| 62 | Asp | Ala, Ser, Gly, Thr, or Asn |
| 63 | Glu | Ala, Ser, Gly, Thr, or Asn |
| Meprin Recognition Site C | | |
| 88 | Glu | Ala, Ser, Gly, Thr, or Asn |
| 89 | Glu | Ala, Ser, Gly, Thr, or Asn |
| Meprin Recognition Site D | | |
| 136 | Glu | Ala, Ser, Gly, Thr, or Asn |
| 137 | Asp | Ala, Ser, Gly, Thr, or Asn |
| 138 | Asp | Ala, Ser, Gly, Thr, or Asn |
| Meprin Recognition Site E | | |
| 169 | Glu | Ala, Ser, Gly, Thr, or Asn |
| 170 | Glu | Ala, Ser, Gly, Thr, or Asn |
| Meprin Recognition Site F* | | |
| 176 | Gln | Ala, Ser, Gly, Thr, or Asn |
| 177 | Glu | Ala, Ser, Gly, Thr, or Asn |
| 178 | Glu | Ala, Ser, Gly, Thr, or Asn |

*Meprin Recognition Site F is not present in the mouse ADAM10 amino acid sequence of SEQ ID NO: 2.

Thus, in some embodiments an ADAM10 modulating peptide of the presently disclosed subject matter comprises, consists essentially of, or consists of an amino acid sequence comprising at least one amino acid substitution of at least one furin recognition site and optionally comprises at least one amino acid substitution of at least one meprin recognition site of SEQ ID NO: 1 or SEQ ID NO: 2, and combinations thereof, such that the ADAM10 modulating peptide is less sensitive to cleavage by furin and optionally by both furin and meprin.

Additionally, in some embodiments non-amino acid substitution modifications can also be included in the ADAM10 modulating peptides of the presently disclosed subject matter. By way of example and not limitation, the ADAM10 modulating peptides of the presently disclosed subject matter can be conjugated to a polyethylene glycol (PEG) moiety (i.e., they can be pegylated). In some embodiments, the ADAM10 modulating peptides of the presently disclosed subject matter can be pegylated at or near the N-terminus and/or at or near the C-terminus. The phrase "at or near" is intended to encompass conjugating a PEG moiety to one of the first about 20 amino acids and/or to one of the last about 20 amino acids of the ADAM10 modulating peptide. There is also a single cysteine amino acid in SEQ ID NOs: 1 and 2 at amino acid position 151, and in some embodiments a PEG moiety can be conjugated to an ADAM10 modulating peptide via the sulfhydryl group of the cysteine. Other moieties besides a PEG moiety can also be conjugated at these positions, including but not limited to sugars, carbohydrate chains, polysarcosines, polyols, short peptides such as those containing proline, alanine, and serine (PAS), and others.

In some embodiments, an ADAM10 modulating peptide of the presently disclosed subject matter can be pegylated at or near the N-terminus, at or near the C-terminus, and/or at Cys151 in any combination, such that the ADAM10 modulating peptide can in some embodiments have one, two, or three PEG moieties conjugated thereto. In some embodiments, the PEG moiety is about 10 kiloDaltons (kDa) in molecular weight, although larger and smaller PEG moieties can also be used.

In some embodiments, Cys151 can also be modified by amino acid substitution. Exemplary substitutions at Cys151 include serine, glycine, alanine, and threonine. Thus, in addition to having 0-3 PEG moieties conjugated to it, an ADAM10 modulating peptide of the presently disclosed subject matter can in some embodiments include modifications at 1, 2, 3, 4, 5, 6, 7, 8, 9, 10, 11, 12, 13, 14, 15, 16, 17, 18, 19, 20, 21, 22, or all 23 amino acid positions listed in Tables 2-3 in addition to position 151. As such, in some embodiments, an ADAM10 modulating peptide of the presently disclosed subject matter comprises 1-24 amino acid substitutions at positions 26-29, 34-36, 52-55, 62, 63, 88, 89, 136-138, 151, 169, 170, and 176-178 of SEQ ID NO: 1. SEQ ID NOs: 3 and 4 provide consensus sequences based on the human and mouse ADAM10 amino acid sequences, respectively, with these amino acid positions defined as in Tables 2-3 in addition to position 151.

It is understood that any combinations of amino acid substitutions at these positions is permitted, and in some embodiments the amino acid substitutions are selected from those in Tables 2-3 in addition to serine, glycine, alanine, or threonine at position 151. A non-limiting subset of the possible amino acid sequences for an ADAM10 modulating peptide of the presently disclosed subject matter is presented in SEQ ID NOs: 5-71,814. Additional non-limiting examples of an ADAM10 modulating peptides of the presently disclosed subject matter are as follows:

In some embodiments, the presently disclosed subject matter provides ADAM10 modulating peptides. In some embodiments, the ADAM10 modulating peptides comprise, consist essentially of, or consist of an amino acid sequence comprising at least one amino acid substitution of at least one furin recognition site of SEQ ID NO: 1 or SEQ ID NO: 2 and optionally further comprises at least one amino acid substitution of at least one meprin recognition site of SEQ ID NO: 1 or SEQ ID NO: 2, and combinations thereof, such that the ADAM10 modulating peptide is less sensitive to cleavage by furin and optionally by both furin and meprin. In some embodiments, the at least one furin recognition site is selected from the group consisting of amino acid positions 26-29 and amino acid positions 52-55 of SEQ ID NOs: 1 or SEQ ID NO: 2; and the at least one meprin recognition site is selected from the group consisting of amino acid positions 34-36, amino acid positions 62/63, amino acid positions 88/89, amino acid positions 136-138, amino acid positions 169/170, and amino acid positions 176-178 of SEQ ID NO: 1; or amino acid positions 34-36, amino acid positions 62/63, amino acid positions 88/89, amino acid positions 136-138, and amino acid positions 169/170 of SEQ ID NO: 2. In some embodiments, cysteine 151 of SEQ ID NO: 1 or SEQ ID NO: 2 is substituted with alanine, serine, glycine, or threonine, or is pegylated. In some embodiments, the ADAM10 modulating peptide comprises, consists essentially of, or consists of an amino acid sequence as set forth in either of SEQ ID NOs: 3 and 4. In some embodiments, the ADAM10 modulating peptide comprises, consists essentially of, or consists of an amino acid sequence that comprises an alanine at one or more of positions 26, 28 and 29 of SEQ ID NO: 3 or SEQ ID NO: 4, an alanine at one or more of positions 52, 54 and 55 of SEQ ID NO: 3 or SEQ ID NO: 4, or any combination thereof; and an alanine at one or both of positions 88 and 89, an alanine at one or more of positions 176-178 of SEQ ID NO: 3, or any combination thereof. In some embodiments, cysteine 151 of SEQ ID NO: 3 or SEQ ID NO: 4 is substituted with alanine, serine, glycine, or threonine, or is pegylated. In some embodiments, the ADAM10 modulating peptide comprises, consists essentially of, or consists of an amino acid sequence that comprises an alanine at one or more of positions 26, 28 or 29 of SEQ ID NO: 3 or SEQ ID NO: 4, an alanine at one or more of positions 52, 54 or 55 of SEQ ID NO: 3 or SEQ ID NO: 4, or any combination thereof. In some embodiments and with reference to SEQ ID NO: 3 or SEQ ID NO: 4, one or both of amino acid positions 29 and 55 are independently selected from the group consisting of alanine and lysine. In some embodiments, the ADAM10 modulating peptide further comprises an alanine at one or more of positions 88, 89, 177, and 178 of SEQ ID NO: 3 and/or at positions 88 and 89 of SEQ ID NO: 4, or any combination thereof. In some embodiments, ADAM10 modulating peptide further comprises a modification at the cysteine at amino acid 151 selected from the group consisting of substitution of the cysteine with serine, glycine, alanine, or threonine and pegylation of the cysteine. In some embodiments, amino acid 151 is serine or cysteine 151 is peglyated.

In some embodiments, the ADAM10 modulating peptide further comprises a modification at the cysteine at amino acid 151 selected from the group consisting of substitution of the cysteine with serine, glycine, alanine, or threonine and pegylation of the cysteine. In some embodiments, amino acid 151 is serine and in some embodiments amino acid 151 is pegylated.

In some embodiments and with reference to SEQ ID NO: 3 or SEQ ID NO: 4, one or both of amino acid positions 29 and 55 are independently selected from the group consisting of serine, glycine, and threonine. In some embodiments, amino acid position 151 of SEQ ID NO: 3 or SEQ ID NO: 4 is a serine, glycine, alanine, or threonine. In some embodiments, amino acid position 151 of SEQ ID NO: 3 or SEQ ID NO: 4 is pegylated. In some embodiments, the N-terminus, the C-terminus, or both are pegylated.

In some embodiments and with reference to SEQ ID NO: 3 or SEQ ID NO: 4, amino acid position 26 is not arginine, amino acid position 27 is not alanine, amino acid position 28 is not lysine, and/or amino acid position 29 is not arginine; and/or amino acid position 52 is not arginine, amino acid position 53 is not methionine, amino acid position 54 is not lysine, and/or amino acid position 55 is not arginine; and/or amino acid position 34 is not glutamic acid, amino acid position 35 is not aspartic acid, and/or amino acid position 36 is not glutamine; amino acid position 62 is not aspartic acid and/or amino acid position 63 is not glutamic acid; and/or amino acid position 88 is selected from the group consisting of alanine, serine, glycine, threonine, and asparagine and/or amino acid position 89 is selected from the group consisting of alanine, serine, glycine, threonine, and asparagine; and/or amino acid position 136 is not glutamic acid, amino acid position 137 is not aspartic acid, and/or amino acid position 138 is not aspartic acid; and/or amino acid position 151 is not cysteine; and/or amino acid position 169 is not glutamic acid and/or amino acid position 170 is not glutamic acid; and/or amino acid positions 176-178 of SEQ ID NO: 3 are each independently selected from the group consisting of glutamine, alanine, serine, glycine, threonine, and asparagine, provided that the amino acid sequence at positions 176-178 is not glutamine/glutamic acid/glutamic acid. In some embodiments, the amino acid at position 151 is selected from the group consisting of serine, glycine, alanine, and threonine. In some embodiments, the N-terminus, the C-terminus, the cysteine at position 151, or any combination thereof is pegylated.

In some embodiments, the ADAM10 modulating peptide comprises, consists essentially of, or consists of one or more modifications that inactivate a furin recognition site at amino acid positions 26-28 of SEQ ID NOs: 1 or SEQ ID NO: 2, a furin recognition site at amino acid positions 52-54 of SEQ ID NOs: 1 or SEQ ID NO: 2, or both.

In some embodiments, the ADAM10 modulating peptide comprises, consists essentially of, or consists of one or more modifications that inactivate a meprin recognition site at amino acid positions amino acid positions 34-36 of SEQ ID NO: 1 or SEQ ID NO: 2, amino acid positions 62 and 63 of SEQ ID NO: 1 or SEQ ID NO: 2, amino acid positions 88 and 89 of SEQ ID NO: 1 or SEQ ID NO: 2, amino acid positions 136-138 of SEQ ID NO: 1 or SEQ ID NO: 2, amino acid positions 169 and 170 of SEQ ID NO: 1 or SEQ ID NO: 2, amino acid positions 176-178 of SEQ ID NO: 1, or any combination thereof.

In some embodiments, the ADAM10 modulating peptide comprises, consists essentially of, or consists of at least two modifications that inactivate the meprin recognition site at amino acid positions 88 and 89 of SEQ ID NO: 1 and amino acid positions 176-178 of SEQ ID NO: 1.

In some embodiments, the ADAM10 modulating peptide comprises, consists essentially of, or consists of a plurality of modifications that inactivate the furin recognition sites at amino acid positions 26-28 and 52-54 of SEQ ID NOs: 1 or SEQ ID NO: 2; and the meprin recognition sites at amino acid positions 34-36, 62 and 63, 88 and 89, 136-138, and 169 and 170 of SEQ ID NO: 1 or SEQ ID NO: 2; and optionally further inactivate the meprin recognition site at amino acid positions 176-178 of SEQ ID NO: 1.

In some embodiments, the ADAM10 modulating peptide comprises, consists essentially of, or consists of a plurality of modifications that inactivate the furin recognition sites at amino acid positions 26-28 and 52-54 of SEQ ID NOs: 1 or SEQ ID NO: 2; and the meprin recognition sites at amino acid positions 88 and 89 and 176-178 of SEQ ID NO: 1.

In some embodiments, the ADAM10 modulating peptide comprises, consists essentially of, or consists of an amino acid sequence that with reference to SEQ ID NO: 1, comprises amino acid substitutions as defined in SEQ ID NO: 3 at one or more of amino acid positions 26-29; and one or more of amino acid positions 52-55; and amino acid positions 88/89; and amino acid positions 176-178. In some embodiments, amino acid position 151 is selected from the group consisting of serine, glycine, alanine, and threonine or the cysteine at amino acid position 151 is pegylated. In some embodiments, the ADAM10 modulating peptide further comprises a PEG moiety at the N-terminus, the C-terminus, amino acid position 151, or any combination thereof. In some embodiments, the ADAM10 modulating peptide further comprises a PEG moiety at the N-terminus, the C-terminus, amino acid position 151, or any combination thereof.

In some embodiments, the ADAM10 modulating peptide further comprises one or more amino acid substitutions as defined in SEQ ID NO: 3 at one or more of the meprin recognition sites at amino acid positions 34-36, 62/63, 136-138, and 169/170 of SEQ ID NO: 1 or SEQ ID NO: 2 and optionally 176-178 of SEQ ID NO: 1. In some embodiments, at least one of the amino acid substitutions is an alanine substitution. In some embodiments, the ADAM10 modulating peptide further comprises a PEG moiety at the N-terminus, the C-terminus, amino acid position 151, or any combination thereof. In some embodiments, the ADAM10 modulating peptide further comprises a PEG moiety at the N-terminus, the C-terminus, amino acid position 151, or any combination thereof.

In some embodiments, the ADAM10 modulating peptide comprises an amino acid sequence as set forth in any of SEQ ID NOs: 5-71,814. In some embodiments and with reference to SEQ ID NO: 1, each of amino acid positions 29 and 55 are substituted with conservative amino acid changes serine, glycine, threonine or serine; at least one of each of amino acid positions 34-36 are substituted are substituted with conservative amino acid changes asparagine, serine, glycine, threonine or serine; at least one of amino acid positions 62 and 63 are substituted with conservative amino acid changes asparagine, serine, glycine, threonine or serine; at least one of amino acid positions 88 and 89 are substituted with conservative amino acid changes asparagine, serine, glycine, threonine or serine; at least one of amino acid positions 136-138 are substituted are substituted with conservative amino acid changes asparagine, serine, glycine, threonine or serine; at least one of amino acid positions 169 and 170 are substituted are substituted with conservative amino acid changes asparagine, serine, glycine, threonine or serine; at least one of amino acid positions 176-178 are substituted with conservative amino acid changes asparagine, serine, glycine, threonine or serine. In some embodiments, the ADAM10 modulating peptide further comprises a PEG moiety at the N-terminus, the C-terminus, amino acid position 151 of SEQ ID NO: 1, or any combination thereof.

In some embodiments, the ADAM10 modulating peptide comprises an amino acid sequence at least 87%, 88%, 89%, 90%, 91%, 92%, 93%, 94%, 95%, 96%, 97%, 98%, or 99% identical to any of SEQ ID NOs: 5-71,814. In some embodiments, the amino acid sequence comprises one or more amino acid substitutions of SEQ ID NOs: 5-6,281 at an amino acid position selected from the group consisting of amino acid positions 26, 28, 29, 34-36, 52, 54, 55, 62, 63, 88, 89, 136-138, 151, 169-178, 182, and 183 as defined in SEQ ID NO: 3 for these amino acid positions.

The phrases "percent identity" and "percent identical," in the context of two protein sequences, refer to two or more sequences or subsequences that have in some embodiments at least 60%, in some embodiments at least 70%, in some embodiments at least 80%, in some embodiments at least 85%, in some embodiments at least 87%, in some embodiments at least 88%, in some embodiments at least 89%, in some embodiments at least 90%, in some embodiments at least 91%, in some embodiments at least 92%, in some embodiments at least 93%, in some embodiments at least 94%, in some embodiments at least 95%, in some embodiments at least 96%, in some embodiments at least 97%, in some embodiments at least 98%, and in some embodiments at least 99% nucleotide or amino acid residue identity, when compared and aligned for maximum correspondence, as measured using one of the following sequence comparison algorithms or by visual inspection. The percent identity exists in some embodiments over a region of the sequences that is at least about 50 residues in length, in some embodiments over a region of at least about 100 residues, and in some embodiments the percent identity exists over at least about 150 residues. In some embodiments, the percent identity exists over the entire length of one of sequences being compared. In some embodiments, the percent identity is calculated over the entire length of the amino acid sequence of the ADAM10 modulating peptide.

For sequence comparison, typically one sequence acts as a reference sequence to which test sequences are compared. When using a sequence comparison algorithm, test and reference sequences are input into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, for example, by the local homology algorithm described in Smith & Waterman, 1981, by the homology alignment algorithm described in Needleman & Wunsch, 1970, by the search for similarity method described in Pearson & Lipman, 1988, by computerized implementations of these algorithms (GAP, BESTFIT, FASTA, and TFASTA in the GCG® WISCONSIN PACKAGE®, available from Accelrys, Inc., San Diego, California, United States of America), or by visual inspection. See generally, Ausubel et al., 1989.

One example of an algorithm that is suitable for determining percent sequence identity and sequence similarity is the BLAST algorithm, which is described in Altschul et al., 1990. Software for performing BLAST analyses is publicly available through the National Center for Biotechnology Information via the World Wide Web. This algorithm involves first identifying high scoring sequence pairs (HSPs) by identifying short words of length W in the query sequence, which either match or satisfy some positive valued threshold score T when aligned with a word of the same length in a database sequence. T is referred to as the neighborhood word score threshold (Altschul et al., 1990). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when the cumulative alignment score falls off by the quantity X from its maximum achieved value, the cumulative score goes to zero or below due to the accumulation of one or more negative scoring residue alignments, or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=4, and a comparison of both strands. For amino acid sequences, the BLASTP program uses as defaults a wordlength (W) of 3, an expectation (E) of 10, and the BLOSUM62 scoring matrix. See Henikoff & Henikoff, 1992.

In addition to calculating percent sequence identity, the BLAST algorithm also performs a statistical analysis of the similarity between two sequences. See e.g., Karlin & Altschul. 1993. One measure of similarity provided by the BLAST algorithm is the smallest sum probability (P(N)), which provides an indication of the probability by which a match between two nucleotide or amino acid sequences would occur by chance. For example, a test nucleic acid sequence is considered similar to a reference sequence if the smallest sum probability in a comparison of the test nucleic acid sequence to the reference nucleic acid sequence is in some embodiments less than about 0.1, in some embodiments less than about 0.01, and in some embodiments less than about 0.001.

In some embodiments, amino acid position 151 is selected from the group consisting of serine, glycine, alanine, and threonine or the cysteine at amino acid position 151 is pegylated. In some embodiments and with reference to SEQ ID NO: 1, at least one of amino acids 26, 28 and 29 and/or at least one of amino acids 52, 54 and 55 are substituted are substituted with conservative amino acid changes serine, glycine, threonine or serine; and at least one amino acids of position 88/89 and/or 176-178 are substituted with conservative amino acid changes asparagine, serine, glycine, threonine or serine. In some embodiments, the ADAM10 modulating peptide further comprises a PEG moiety at the N-terminus, the C-terminus, amino acid position 151 of SEQ ID NO: 1, or any combination thereof.

The presently disclosed subject matter also provides in some embodiments ADAM10 modulating peptides comprising, consisting essentially of, or consisting of SEQ ID NO: 1 or SEQ ID NO: 2 conjugated to a PEG moiety. In some embodiments, the PEG moiety is conjugated to the cysteine at amino acid position 151 of SEQ ID NO: 1 or SEQ ID NO: 2.

The presently disclosed subject matter also provides in some embodiments ADAM10 modulating peptides comprising, consisting essentially of, or consisting of an amino acid sequence as set forth in any one of SEQ ID NOs: 5, 6, 9, 34, 36, and 62-71. In some embodiments, the peptide comprises, consists essentially of, or consists of an amino acid sequence as set forth in SEQ ID NO: 62 or SEQ ID NO: 63.

The presently disclosed subject matter also provides in some embodiments ADAM10 modulating peptides comprising, consisting essentially of, or consisting of an amino acid sequence that is at least 87%, 88%, 89%, 90%, 91%, 92%, 93%, 94%, 95%, 96%, 97%, 98%, or 99% identical to any one of SEQ ID NOs: 5, 6, 9, 34, 36, and 62-71. In some embodiments, the amino acid sequence is at least 87%, 88%, 89%, 90%, 91%, 92%, 93%, 94%, 95%, 96%, 97%, 98%, or 99% identical to SEQ ID NO: 62 or SEQ ID NO: 63.

The presently disclosed subject matter also provides in some embodiments ADAM10 modulating peptides comprising, consisting essentially of, or consisting of an amino acid sequence that is at least 87%, 88%, 89%, 90%, 91%, 92%, 93%, 94%, 95%, 96%, 97%, 98%, or 99% identical to SEQ ID NO: 3 of SEQ ID NO: 4. In some embodiments, as compared to SEQ ID NO: 3, the amino acid sequence comprises one or more conservative amino acid substitutions at one or more positions selected from the group consisting of positions 39, 48, 73, 107, 115, 126, 135, 171-175, 182, and 183 of SEQ ID NO: 3 or the corresponding positions in SEQ ID NO: 4. In some embodiments, as compared to SEQ ID NO: 3, the amino acid sequence comprises a leucine substitution at amino acid position 39, an alanine substitution at amino acid position 48, a proline substitution at amino acid position 73, a lysine substitution at amino acid position 107, an isoleucine substitution at amino acid position 115, an isoleucine substitution at amino acid position 126, or any combination thereof. In some embodiments, as compared to SEQ ID NO: 3, the amino acid sequence is selected from the group consisting of SEQ ID NOs: 64-66. In some embodiments, the amino acid sequence is at least 87%, 88%, 89%, 90%, 91%, 92%, 93%, 94%, 95%, 96%, 97%, 98%, or 99% identical to any one of SEQ ID NOs: 5, 6, 9, 34, 36, and 62-71. In some embodiments, the amino acid sequence comprises at least one introduction of a cysteine into any one of SEQ ID NOs: 5, 6, 9, 34, 36, and 62-71 internally, at the N-terminus, at the C-terminus, or any combination thereof, and further wherein the at least one introduced cysteine results from a substitution of one or more amino acids of SEQ ID NOs: 5, 6, 9, 34, 36, and 62-71, an insertion of a cysteine into any one of SEQ ID NOs: 5, 6, 9, 34, 36, and 62-71, or any combination thereof. In some embodiments, the introduced cysteine is pegylated. In some embodiments, the pegylated introduced cysteine is located within the first 20 amino acids of any one of SEQ ID NOs: 5, 6, 9, 34, 36, and 62-71; within the last 20 amino acids of any one of SEQ ID NOS: 5, 6, 9, 34, 36, and 62-71.

With respect to ADAM10 modulating peptides that have 87-100% identity (e.g., at least 87%, 88%, 89%, 90%, 91%, 92%, 93%, 94%, 95%, 96%, 97%, 98%, 99%, or 100% identity) to one of SEQ ID NOs: 1-71,814, in some embodiments an amino acid substitution occurs at a position other than one of the furin recognition sites, one of the meprin recognition sites, or Cys151 of SEQ ID NO: 1 or SEQ ID NO: 2. As such, in some embodiments an ADAM10 modulating peptide of the presently disclosed subject matter includes an amino acid substitution, optionally a conservative amino acid substitution, at another amino acid position of SEQ ID NOs: 1-4. As used herein, the phrases "conservative amino acid substitution" and "conservative amino acid change" are used interchangeably to refer to amino acid substitutions that are contemplated to impact a biological activity of the ADAM10 modulating peptide as little as possible. Table 4 lists exemplary conservative amino acid substitutions.

TABLE 4

Representative Conservative Amino Acid Substitutions

| Amino Acid Property | Amino Acid |
|---|---|
| Basic | arginine; lysine; histidine |
| Acidic | glutamic acid; aspartic acid |
| Polar | glutamine; asparagine |
| Hydrophobic | leucine; isoleucine; valine |
| Aromatic | phenylalanine; tryptophan; tyrosine |
| Small | glycine; alanine; serine; threonine; methionine |

Amino acid substitutions, such as those that might be employed in modifying a furin and/or a meprin recognition site of an ADAM10 modulating peptide of the presently claimed subject matter are generally, but not necessarily, based on the relative similarity of the amino acid side-chain substituents, for example, their hydrophobicity, hydrophilicity, charge, size, and the like. An analysis of the size, shape, and type of the amino acid side-chain substituents reveals that arginine, lysine, and histidine are all positively charged residues; that alanine, glycine, and serine are all of similar size; and that phenylalanine, tryptophan, and tyrosine all have a generally similar shape. Therefore, based upon these considerations, arginine, lysine, and histidine; alanine, glycine, and serine; and phenylalanine, tryptophan, and tyrosine are defined herein as biologically functional equivalents. Other biologically functionally equivalent changes will be appreciated by those of ordinary skill in the art. It is implicit in the above discussion, however, that one of skill in the art can appreciate that a radical, rather than a conservative substitution can be warranted in a given situation. Non-conservative substitutions at any position of any of SEQ ID NOs: 5-71,814 of the presently claimed subject matter are also an aspect of the presently claimed subject matter.

In making biologically functional equivalent amino acid substitutions, the hydropathic index of amino acids can be considered. Each amino acid has been assigned a hydropathic index on the basis of their hydrophobicity and charge characteristics. The assigned hydropathic indices are: isoleucine (+4.5); valine (+4.2); leucine (+3.8); phenylalanine (+2.8); cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamic acid (−3.5); glutamine (−3.5); aspartic acid (−3.5); asparagine (−3.5); lysine (−3.9); and arginine (−4.5).

The importance of the hydropathic amino acid index in conferring interactive biological function on a protein is generally understood in the art (Kyte & Doolittle, 1982). It is known that certain amino acids can be substituted for other amino acids having a similar hydropathic index or score and still retain a similar biological activity. In making changes based upon the hydropathic index, the substitution of amino acids whose hydropathic indices can be in one embodiment within ±2 of the original value, in another embodiment within ±1 of the original value, and in still another embodiment within ±0.5 of the original value.

It is also understood in the art that the substitution of like amino acids can be made effectively on the basis of hydrophilicity. U.S. Pat. No. 4,554,101 to Hopp, incorporated herein by reference, states that the greatest local average hydrophilicity of a protein, as governed by the hydrophilicity of its adjacent amino acids, correlates with its immunogenicity and antigenicity; that is, with a biological property of the protein. It is understood that an amino acid can be substituted for another having a similar hydrophilicity value and still obtain a biologically equivalent protein.

As detailed in U.S. Pat. No. 4,554,101, the following hydrophilicity values have been assigned to amino acid residues: arginine (+3.0); lysine (+3.0); aspartic acid (+3.0±1); glutamic acid (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); and tryptophan (−3.4).

In making changes based upon similar hydrophilicity values, the substitution of amino acids whose hydrophilicity values can be in one embodiment within ±2 of the original value, in another embodiment within ±1 of the original value, and in still another embodiment within ±0.5 of the original value.

In some embodiments, the amino acid sequence comprises at least one introduction of a cysteine into any one of SEQ ID NOs: 5-6,281 internally, at the N-terminus, at the C-terminus, or any combination thereof, and further wherein the at least one introduced cysteine results from a substitution of one or more amino acids of SEQ ID Nos: 5-6281, or any combination thereof. In some embodiments, the introduced cysteine is pegylated. In some embodiments, the pegylated introduced cysteine is located within the first 20 amino acids of any one of SEQ ID NOs: 5-6,281; within the last 20 amino acids of any one of SEQ ID NOs: 5-6,281.

In some embodiments, the amino acid sequence comprises at least one introduction of a cysteine into any one of SEQ ID NOs: 6,282-71,814 internally, at the N-terminus, at the C-terminus, or any combination thereof, and further wherein the at least one introduced cysteine results from a substitution of one or more amino acids of SEQ ID Nos: 6,282-71,814, or any combination thereof. In some embodiments, the introduced cysteine is pegylated. In some embodiments, the pegylated introduced cysteine is located within the first 20 amino acids of any one of SEQ ID NOs: 6,282-71,814; within the last 20 amino acids of any one of SEQ ID NOs: 5-6281.

In some embodiments, the amino acid sequence comprises at least one introduction of a cysteine into any one of SEQ ID NOs: 3 and 4 internally, at the N-terminus, at the C-terminus, or any combination thereof, and further wherein the at least one introduced cysteine results from a substitution of one or more amino acids of SEQ ID Nos: 3 and 4, or any combination thereof. In some embodiments, the introduced cysteine is pegylated. In some embodiments, the pegylated introduced cysteine is located within the first 20 amino acids of any one of SEQ ID NOs: 3 and 4; within the last 20 amino acids of any one of SEQ ID NOs: 3 and 4.

The presently disclosed subject matter also provides compositions, optionally pharmaceutical compositions, comprising one or more ADAM10 modulating peptides as disclosed herein.

In some embodiments of the ADAM10 modulating peptides of the presently disclosed subject matter, the ADAM10 modulating peptide comprises one or more modifications selected from the group consisting of conservative amino acid substitutions, non-natural amino acid substitutions, D- or D,L-racemic mixture isomer form amino acid substitutions, amino acid chemical substitutions, carboxy- or amino-terminal modifications, addition of one or more glycosyl groups, and conjugation to a molecule selected from the group consisting of a fatty acid, a PEG, a sugar, a fluorescent molecule, a chromophore, a radionuclide, a bioconjugate, a tag that can be employed for purification and/or isolation of the ADAM10 modulating peptide, and an antibody or a paratope-containing fragment or derivative thereof.

II.B. Compositions and Pharmaceutical Compositions and Polypeptides

In some embodiments, the ADAM10 modulating peptides of the presently disclosed subject matter are present singly or in combination with each other in a composition or a pharmaceutical composition. In some embodiments, a pharmaceutical composition is a composition that comprises one or more ADAM10 modulating peptides as set forth herein and a pharmaceutically acceptable carrier or excipient. In some embodiments, the pharmaceutically composition is pharmaceutically acceptable for use in a human. Suitable formulations include aqueous and non-aqueous sterile injection solutions which can contain anti-oxidants, buffers, bacteriostats, bactericidal antibiotics, and solutes which render the formulation isotonic with the bodily fluids of the intended recipient; and aqueous and non-aqueous sterile suspensions which can include suspending agents and thickening agents. The formulations can be presented in unit-dose or multi-dose containers, for example sealed ampoules and vials, and can be stored in a frozen or freeze-dried (lyophilized) condition requiring only the addition of sterile liquid carrier, for example water for injections, immediately prior to use.

Some exemplary ingredients are sodium dodecyl sulfate (SDS) in the range of in some embodiments 0.1 to 10 mg/ml, in some embodiments about 2.0 mg/ml; and/or mannitol or another sugar in the range of in some embodiments 10 to 100 mg/ml, in some embodiments about 30 mg/ml; and/or phosphate-buffered saline (PBS). Any other agents conventional in the art having regard to the type of formulation in question can be used.

III. Methods for Using the Presently Disclosed ADAM10 Modulating Peptides, Compositions, Pharmaceutical Compositions, and Polypeptides In some embodiments, the presently disclosed subject matter also provides methods for using the presently disclosed ADAM10 modulating peptides.

In some embodiments, the presently disclosed subject matter relates to methods for modulating ADAM10 biological activities in vitro. In some embodiments, the methods comprise contacting a solution or a cell comprising an ADAM10 polypeptide with one or more ADAM10 modulating peptides as disclosed herein, wherein the contacting comprises contacting the ADAM10 polypeptide with an amount of the ADAM10 modulating peptide sufficient to modulate a biological activity of the ADAM10 polypeptide.

In some embodiments, the presently disclosed subject matter relates to methods for inhibiting ADAM10 biological activities in vivo. In some embodiments, the methods comprise administering to a subject a composition comprising, consisting essentially of, or consisting of one or more ADAM10 modulating peptides of the presently disclosed subject matter via a route and in an amount sufficient to inhibit a biological activity of an ADAM10 polypeptide in the subject.

III.A. Methods for Inhibiting ADAM10 Biological Activities, Including ADAM10 Biological Activities Associated with Diseases, Disorders, and Conditions in Subjects In some embodiments, the presently disclosed subject matter relates to methods for inhibiting ADAM10 biological activities associated with a disease, disorder, or condition in a subject. In some embodiments, the methods comprise contacting an ADAM10 polypeptide present in the subject with an effective amount of one or more of the ADAM10 modulating peptides disclosed herein, wherein the disease or disorder is selected from the group consisting of cancer, inflammation, an allergic response, lupus, asthma, an infectious disease, and fibrosis, and further wherein the subject has the disease, disorder, or condition or is predisposed thereto. In some embodiments, the disease, disorder, or condition results at least in part from excess cell proliferation associated with an ADAM10 biological activity. In some embodiments, the disease, disorder, or condition is characterized at least in part by presence of an excess of ADAM10 biological activity or protein.

III.B. Methods for Inhibiting Release of ADAM10 Substrates

In some embodiments, the presently disclosed subject matter relates to methods for inhibiting release of ADAM10 substrates from cells. In some embodiments, the methods comprise contacting the cell with one or more ADAM10 modulating peptides as disclosed herein in an amount sufficient to inhibit release of the ADAM10 substrate from the cell. As used herein, the phrase "ADAM10 substrate" refers to any substrate upon which an ADAM10 polypeptide can act and that results in release of the substrate from a cell. Exemplary, non-limiting ADAM10 substrates include CD23, IL6-R, EGF, Her-2, HB-EGf, betacellulin, jagged-1, Notch receptor 1, Notch receptor 3, RAGE, fractalkine, MICA A, I-TAC, HGFR, GITR, GM-CSF, an IGF soluble receptor, and TGF beta. In some embodiments, the cell is present in a subject and the release of the ADAM10 substrate is into the subject's circulation.

EXAMPLES

The following EXAMPLES provide illustrative embodiments. In light of the present disclosure and the general level of skill in the art, those of skill will appreciate that the following EXAMPLES are intended to be exemplary only and that numerous changes, modifications, and alterations

Example 1

The Non-Pegylated Human Prodomain Peptides of ADAM10 Inhibit ADAM10 In Vitro and are Selective Inhibitors ADAM10 prodomain peptides were prepared by cloning a nucleotide sequence encoding amino acids 23-211 of the human ADAM10 polypeptide as set forth in Accession No. NP_001101.1 of the GENBANK® biosequence database (SEQ ID NO: 1) along with a His tag into a plasmid vector. The prodomain peptides were prepared by transformation of BL21DE3 cells followed by expression at 16° C. This yielded both a soluble prodomain peptide and a prodomain peptide in inclusion bodies. The soluble prodomain peptide was purified by breaking the bacteria in 50 mM Tris pH 8 and 5 mM with or without Tris(2-carboxyethyl) phosphine (TCEP; Gold Biotechnology, Inc., St. Louis, Missouri, United States of America) with 1 mg/ml lysozyme (Sigma-Aldrich Corp., St. Louis, Missouri, United States of America), benzonase, (Sigma-Aldrich) protease inhibitor cocktail (Gold Biotechnology), and 1× CELLLYTIC® solution (Sigma-Aldrich) for 15-20 minutes at room temperature. The pellet after centrifugation was again treated with the same buffer and centrifuged once more. Both supernatants were applied to a Ni-NTA column. After washing, the prodomain peptide was eluted with IM imidazole, 20 mM Tris, pH 8 with or without 5 mM TCEP. The material was then passed over a SUPERDEX® 200 brand column (GE Healthcare Bio-Sciences, Pittsburgh, Pennsylvania, United States of America) equilibrated in 20 mM Tris pH 8 and 40 mM NaCl. After concentration and endotoxin removal, glycerol was added to 10% and the material was stored at −20° C.

Insoluble prodomains were prepared from inclusion bodies after solubilization with urea and then refolding on the Ni-NTA beads. They were then either passed through the SUPERDEX® 200 brand column as described above or put directly through ZEBA™ brand spin columns equilibrated in 20 mM Tris, pH 8 and 40 mM NaCl buffer (7K molecular weight cutoff). Table 5 below presents the $IC_{50}$ values for the ADAM10 peptides and selectivity profiles for some of the inhibitors.

Example 2

Pegylation

The prodomain peptides were passed through a ZEBA™ brand spin column equilibrated in 20 mM phosphate, pH 7.2, with or without 4 mM TCEP. A 1.2-fold to five-fold excess of 10 kDa maleimide PEG (Nanocs Inc. Boston, Massachusetts, United States of America) was added. After 2-8 hours, the reaction progress was monitored by SDS PAGE gel electrophoresis. Sometimes more maleimide PEG was added and the reaction was allowed to proceed overnight in the cold. The material was then passed twice over a SUPERDEX® 200 brand G200 column equilibrated in 20 mM Tris, pH 8, and 40 mM NaCl, fractions containing the pure pegylated material were concentrated and reacted with Endotoxin removal columns and frozen at −20° C. after addition of glycerol to 10%. Prodomain peptides were prepared as described above and pegylation was performed with 10 kDa maleimide PEG.

Example 3

Enzyme Inhibition Assays

PEPDAB064, a fluorescence energy transfer substrate for ADAM family members (BioZyme Inc., Apex, North Carolina, United States of America) was diluted from a 10 mM DMSO stock into 1.5 ml of 25 mM Tris, pH 8 and 0.001% BRIJ® 35 brand detergent to a final concentration of 15 μM. A prodomain peptide of ADAM10 or pegylated prodomain was serially diluted 3-fold after dilution with Tris/BRIJ® buffer without the substrate. To a 96 well black coated plate was added 60 μl of the substrate/buffer mix and 10 μl of prodomain peptide. Human ADAM10 from R & D Systems (Minneapolis, Minnesota, United States of America) at 2 μM was diluted 160-fold into the same Tris/BRIJ® buffer. A total of 5 μl was added to initiate the reaction. Fluorescence readings were taken at 485 nm excitation and 530 nm emission in a Cambridge or FLUOstar fluorometer with readings every two minutes. The data were analyzed with Excel and Prism software. Experiments were run in duplicate. Table 5 presents the inhibition constants against ADAM10 for the prodomain peptides tested.

TABLE 5

| $IC_{50}$ values for Prodomains | |
|---|---|
| Construct | $IC_{50}$ (nM) |
| SEQ ID NO: 1 (human wild type) | 17 ± 3.8 |
| Cys151-pegylated SEQ ID NO: 1 | 49 ± 10 |
| SEQ ID NO: 5 (mut 1; K28A; K54A) | 104 ± 60 |
| Cys151-pegylated SEQ ID NO: 5 (K28A; K54A) | 83 ± 23 |
| SEQ ID NO: 6 (mut2; K28A; K54A; C151S) | 106 ± 29.7 |
| SEQ ID NO: 9 (mut3; K28A; K54A; E88A; E177A) | 142 ± 37.7 |
| SEQ ID NO: 34 (R29A; C151S; E177A) | 95 ± 15 |
| SEQ ID NO: 62 (R29A; R55A; C151S; E177A) | 110 ± 11 |
| SEQ ID NO: 63 (R29K; R55K; C151S; E177A) | 35 ± 9.2 |
| SEQ ID NO: 64 (SEQ ID NO: 2 with R29K; R55K; C151S) | 83 ± 19 |
| SEQ ID NO: 65 (R26A; R52A; C151S) | 49 ± 21 |
| SEQ ID NO: 66 (SEQ ID NO: 1/SEQ ID NO: 2 hybrid; R26A; R55A; C151S; E177A) | 234 ± 40 |
| SEQ ID NO: 67 ((SEQ ID NO: 1/ SEQ ID NO: 2 hybrid; R26A; R52A; C151S) | 147 ± 20 |
| SEQ ID NO: 68 (R26A; R55A; C151S) | 130 ± 40 |
| C-term PEG-SEQ ID NO: 69 (R29K; R55K; E177A) | 71 ± 9 |
| N-term PEG-SEQ ID NO: 70 (R29K; R55K; C151S; E177A) | 52 ± 10 |
| C-term PEG-SEQ ID NO: 71 (R29K; R55K; C151S; E177A) | 19 ± 1 |

Example 4

Selectivity Profile

The human prodomain pegylated or non-pegylated peptides were reacted with ADAM17, ADAM9, or ADAM8 from R & D Systems (Minneapolis, Minnesota, United States of America) with the same substrate buffer mix as described for ADAM10. There was only slight inhibition for the mutants and pegylated versions. The mutants and pegylated versions were also tested against ADAM8 and ADAM9 from R&D Systems using 15 μM PEPDAB064 with the same Tris/BRIJ® brand buffer except that NaCl was added to 150 mM and CaCl$_2$) to 10 mM. There was either no inhibition of these enzymes or slight inhibition, at 4-10 µM.

In addition, inhibition of MMPs was performed by reacting MMPs with ADAM10 peptides of the presently disclosed subject matter using 15 µM PEPDAB008 with the same buffer as above for ADAM8. Table 6 summarizes representative samples.

TABLE 6

Inhibition of ADAM17, ADAM9, and MMPs with ADAM10 Peptides

| Construct | ADAM17 | ADAM9 | MMP (2, 3, 9, 12, 14) |
|---|---|---|---|
| SEQ ID NO: 1 (wild type) | 28% at 8 µM | 0% at 8 µM | 0% at 8 µM |
| PEG-SEQ ID NO: 1 (wild type) | 33% at 6.7 µM | | |
| SEQ ID NO: 6 | 43% at 10 µM | | |
| SEQ ID NO: 34 | 13% at 6.2 µM | 0% at 3.2 µM | |
| SEQ ID NO: 62 | 13% at 4 µM | 0% at 6.2 µM | 0% at 8 µM |
| SEQ ID NO: 64 | 0% at 7.7 µM | 56% at 7.5 µM | |

Meprin was also tested as ADAM10 prodomain is a substrate for this enzyme. Meprin was purchased from R & D Systems and was activated according the manufacturer's instructions. To 20 mM Tris buffer, pH 8 and 1 mM 4-(2-aminoethyl)benzenesulfonyl fluoride hydrochloride (AEBSF) (Gold Biotechnology) was added PEPDAB022 (BioZyme Inc.) to a final concentration of 15 µM. Mutants or wild-type (i.e., SEQ ID NO: 1) ADAM10 modulating peptides or pegylated versions thereof were then added. Since meprin is activated with trypsin and thereafter quenched with AEBSF, the buffer control contained the same amount of trypsin and AEBSF as the reactions with meprin. Reactions were run at room temperature under in the presence of low amounts of meprin and short reaction times to minimize cleavage of the ADAM10 modulating peptides. Table 7 presents the IC$_{50}$ values for inhibition of meprin by ADAM10 modulating peptides. The most meprin-stable ADAM10 modulating peptides were those with a double furin mutation at positions 29 and 55 (SEQ ID NO: 62 and SEQ ID NO: 63) or with the mouse prodomain (SEQ ID NO: 64) and mouse C terminal tail (SEQ ID NO: 67). Furthermore, if the ADAM10 modulating peptide such as SEQ ID NO: 63 was pegylated at the N- or C-terminus or at C151, the IC$_{50}$ increased to about 5-7 µM, indicating that pegylation decreased potency against meprin.

TABLE 7

IC$_{50}$ Values for Inhibition of Meprin Cleavage by Various ADAM10 Modulating Peptides

| Construct | IC$_{50}$ (nM) |
|---|---|
| SEQ ID NO: 1 (wild type) | 185 ± 22 |
| SEQ ID NO: 34 | 289 ± 57 |
| SEQ ID NO: 62 | 817 ± 109 |
| SEQ ID NO: 63 | 542 ± 204 |
| SEQ ID NO: 64 | 682 ± 115 |
| SEQ ID NO: 65 | 289 ± 40 |
| PEG-SEQ ID NO: 69 | ~5 µM |
| PEG-SEQ ID NO: 70 | ~7 µM |
| PEG-SEQ ID NO: 71 | ~4 µM |

Example 5

The Human Prodomains of ADAM10 Inhibit In Vitro Cellular Proliferation

Cells were plated at Day 1 at their optimal cell concentration onto a 96-well plate. Cells were plated (100 µL/well) in complete growth media supplemented with 10% serum. The following day (Day 2) the culture medium was removed, cells were washed with medium without serum, and cells were starved for 24 hours in medium supplemented with 3% serum. Test articles were prepared by dilution into media. Following the starvation, medium was removed and replaced with 100 µl fresh starvation medium. Two test articles and vehicle at 2× concentration was diluted in starvation medium and 100 µl 2× test article or vehicle was loaded onto the appropriate wells. The test articles and vehicle were diluted 10-fold into the same serum starvation media, and 100 µl was added of each. The final concentrations were 2 µM and 0.2 µM.

Each treatment condition was run in a minimum of quadruplicates. Cells were left to incubate at 37° C. for 48 hours.

Quantitative assessment: At the end of the incubation time of 72 hours, a Cell glo assay was used to quantify the number of cells. Media were taken and ELISAs were performed to determine levels of ADAM10 substrates in the media after prodomain peptide treatment or vehicle control.

Figure 5A:
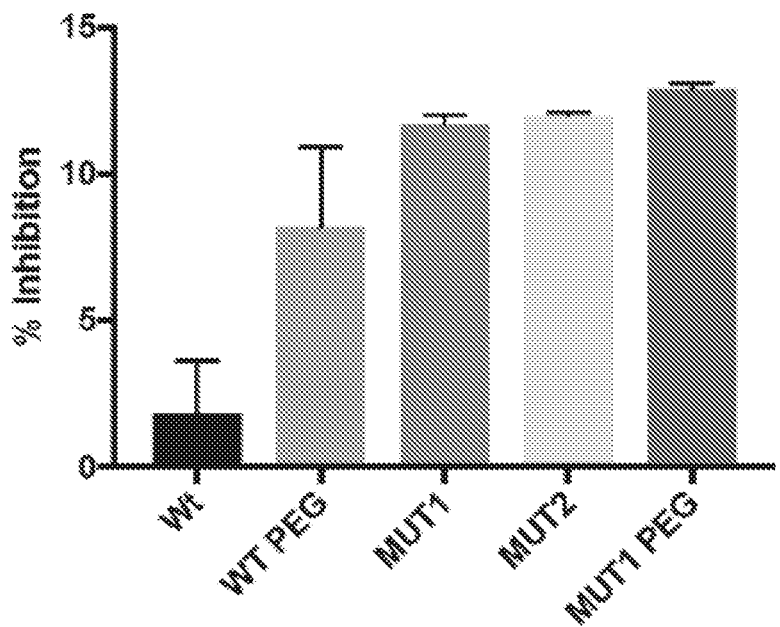
FIG. 5A is a bar graph of percent inhibition of MDA-MB-468 cell proliferation in the presence of SEQ ID NO: 1 (Wt), SEQ ID NO: 1 pegylated at cysteine 151 (WT PEG), SEQ ID NO: 5 (MUT1), SEQ ID NO: 6 (MUT2), or pegylated SEQ ID NO: 5 (MUT1 PEG). Error bars are ±standard error of the mean (SEM) calculated from samples run in quadruplicate.

The mutant and pegylated ADAM10 modulating peptides inhibited proliferation of MDA-MB468 cells to a larger degree than the wild type prodomain peptide (see FIG. 5A).

In another experiment, the effect on proliferation of MDA-MB-468 cells was determined with SEQ ID NO: 62 as the tested ADAM10 modulating peptide. Cells were seeded in 100 µl of growth media in a 96 well plate. The cells were placed in a humidified incubator at 37° C. with 5% CO$_2$ and 95% air for 24 hours. After 24 hours of incubation, cells were washed with serum-free medium and were incubated for 48 hours in starvation medium. Starvation media was then removed and fresh starvation media (180 µl) containing Nuclight Red dye was added to each well. Cell numbers were quantified with an INCUCYTE® brand live cell analysis system (Essen BioScience, Ann Arbor, Michigan, United States of America) over the course of 72 hours.

Figure 5B:
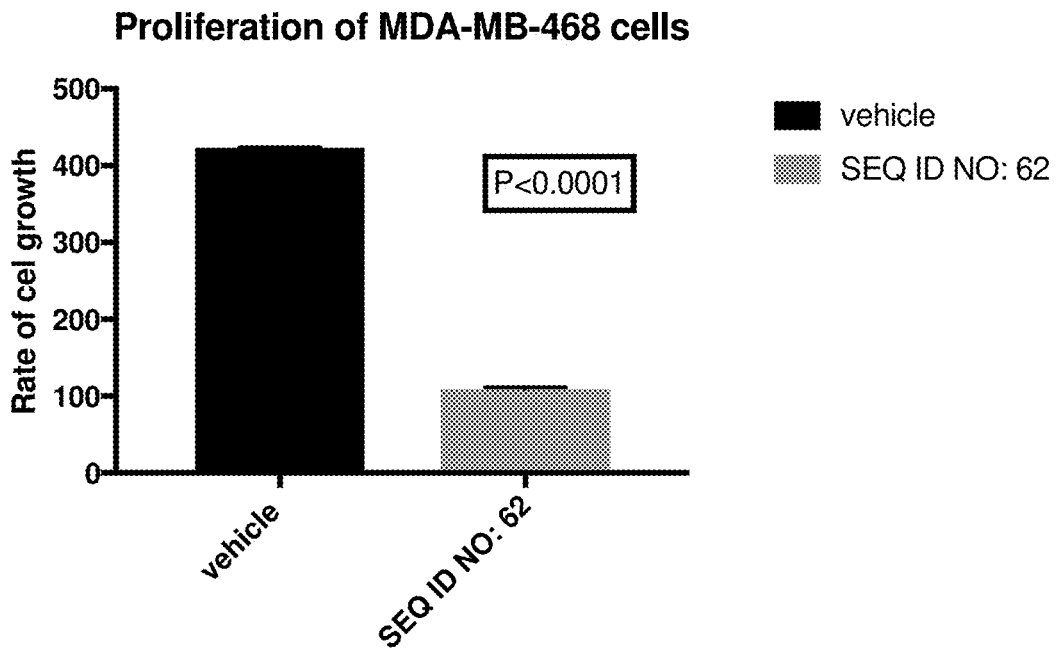
FIG. 5B is a bar graph of the rate of cell growth of MDA-MB-468 in the presence of vehicle (20 mM Tris, 40 mM NaCl, 10% glycerol) or SEQ ID NO: 62. $P<0.0001$. Error bars are ±standard error of the mean (SEM) calculated from samples run in quadruplicate.
Figure 6A:
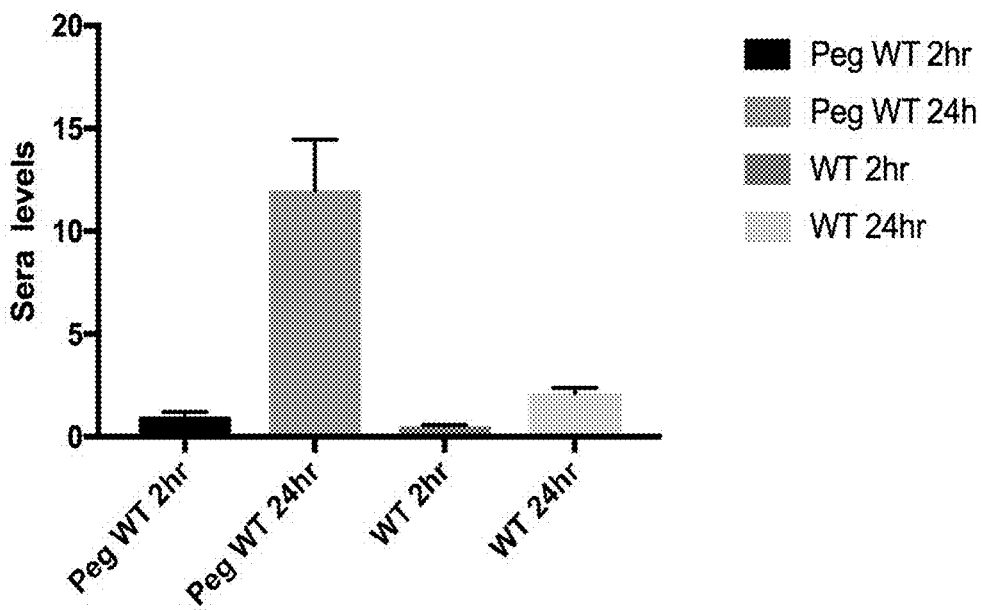
FIGS. 6A-6D are bar graphs presenting the results of experiments testing the pharmacokinetic properties of various modified ADAM10 peptides as measured by the abilities of sera isolated from mice that had received a single intraperitoneal dose of those various modified ADAM10 peptides to inhibit ADAM10 activity.
Figure 6B:
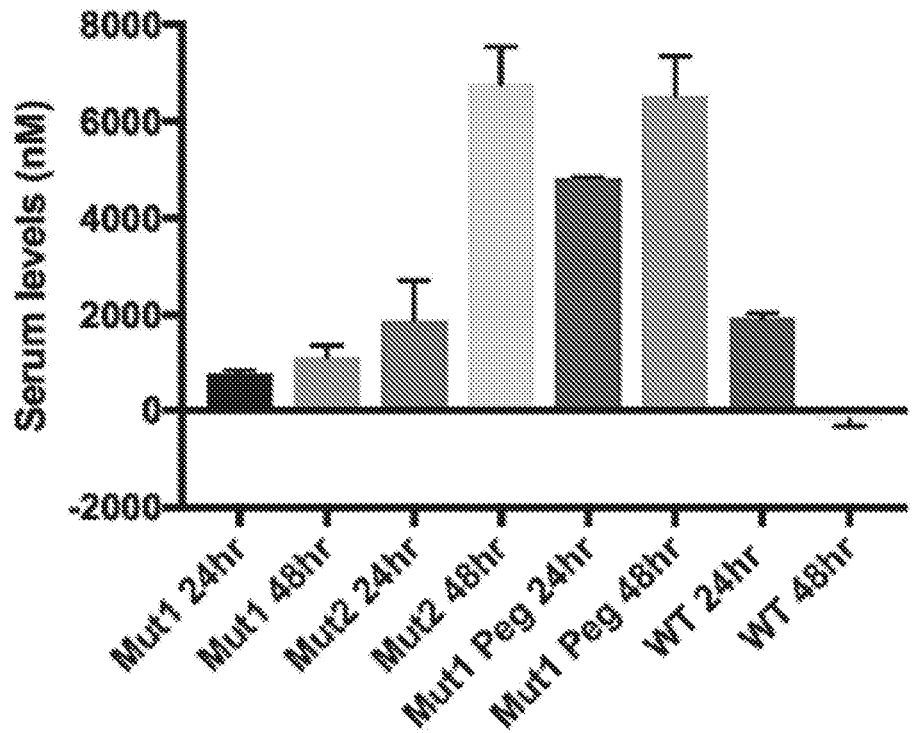
Figure 6C:
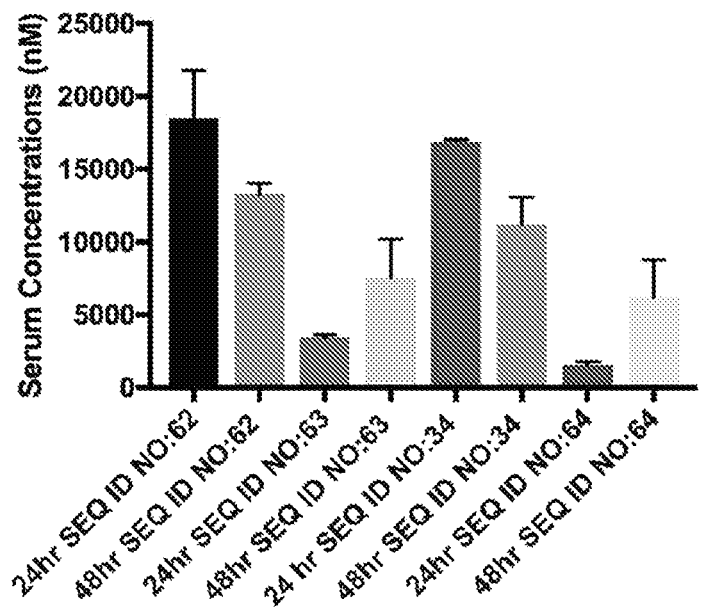
Figure 6D:
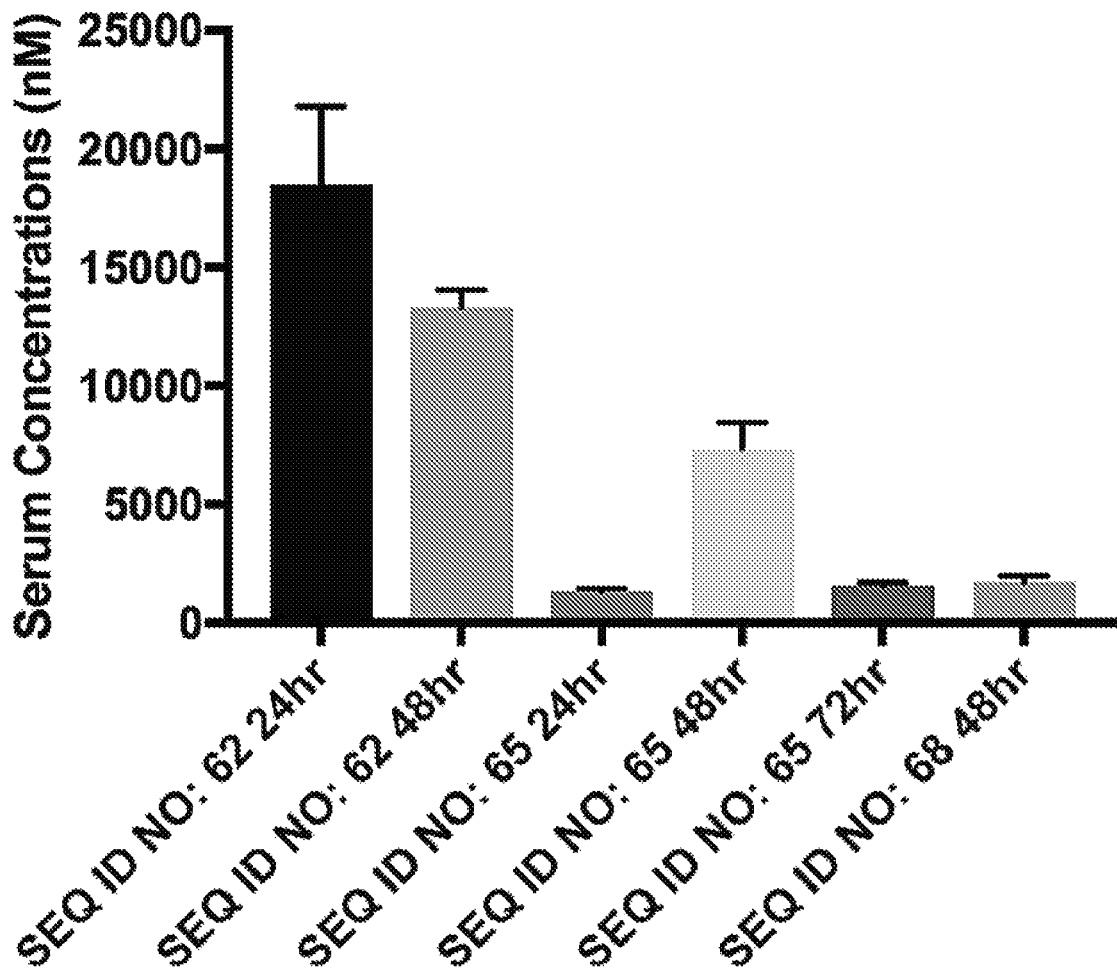
Figure 7:
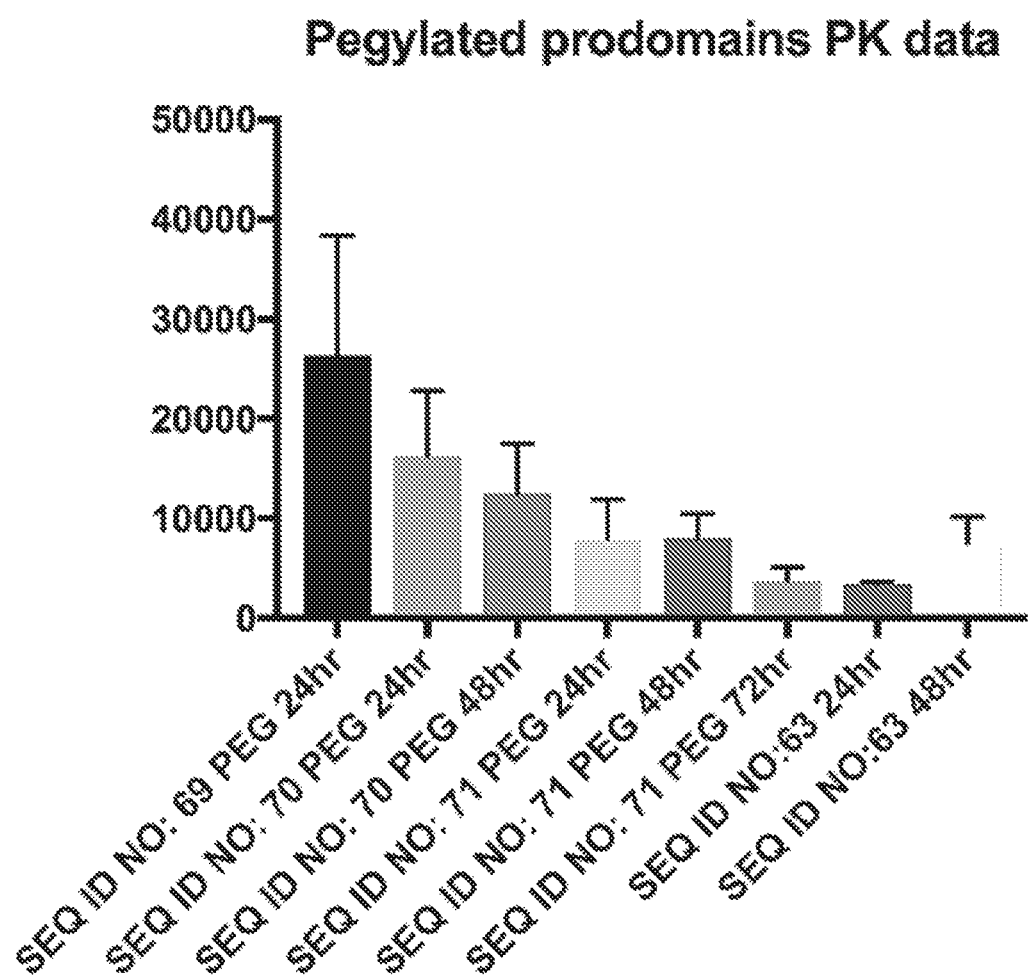
FIG. 7 is a bar graph showing serum concentrations (in nM) of modified ADAM10 peptides.
Figure 8A:
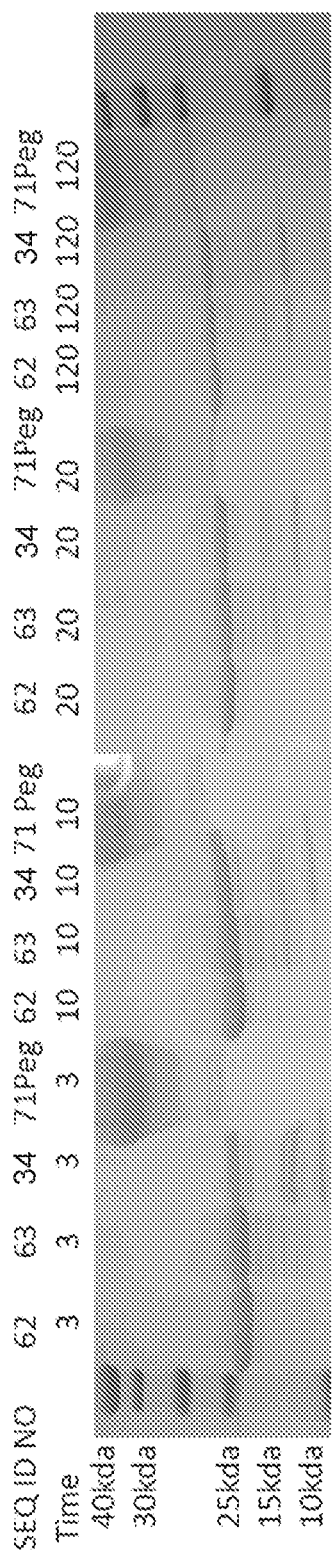
FIGS. 8A-8C are images of Coomassie-stained SDS-PAGE gels showing the results of testing the noted SEQ ID NOs. for resistance to cleavage by furin.
Figure 8B:
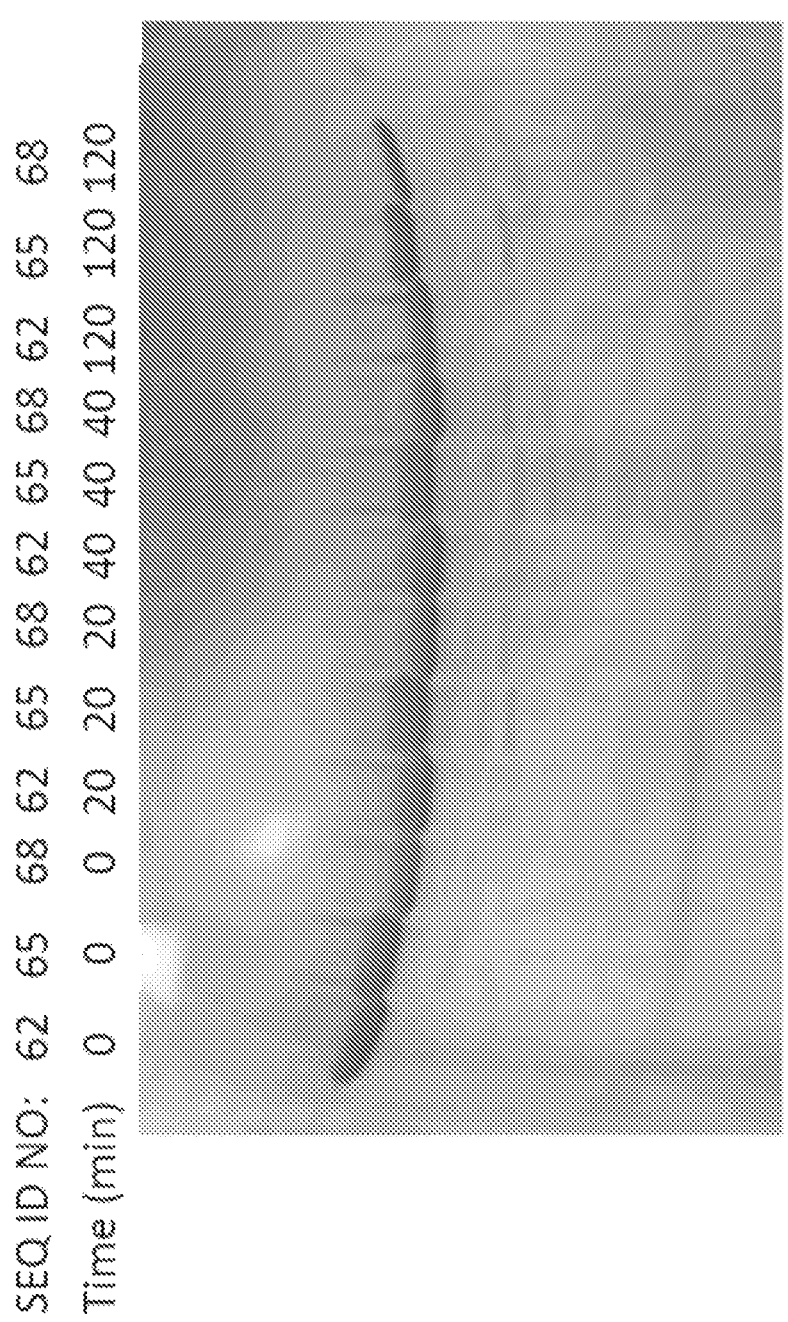
Figure 8C:
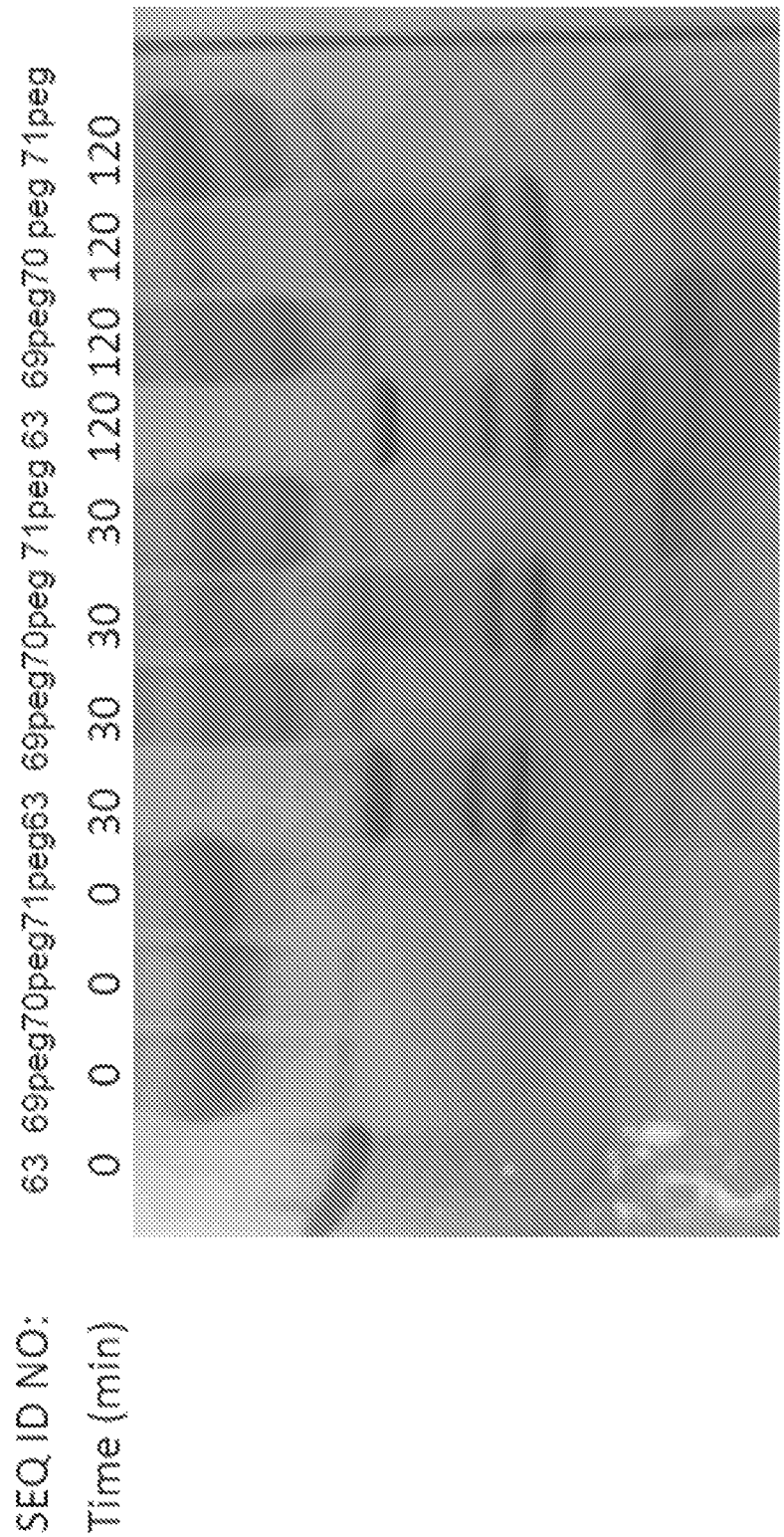
Figure 9A:
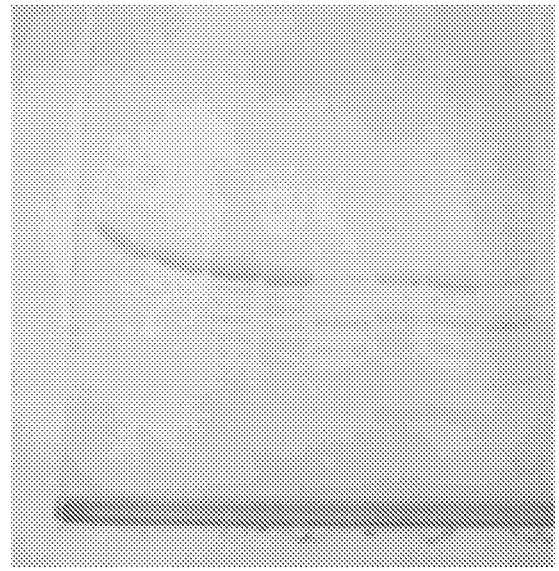
FIGS. 9A-9C are images of Coomassie-stained SDS-PAGE gels showing the results of testing the noted SEQ ID NOs. for resistance to cleavage by meprin.
Figure 9B:
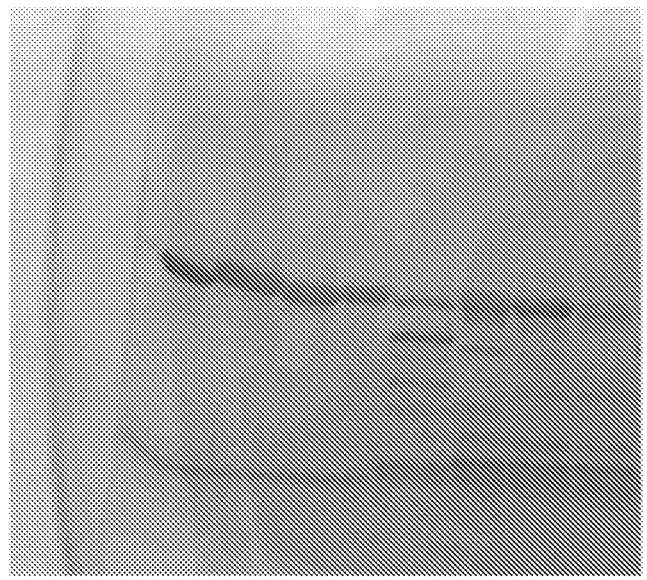
Figure 9C:
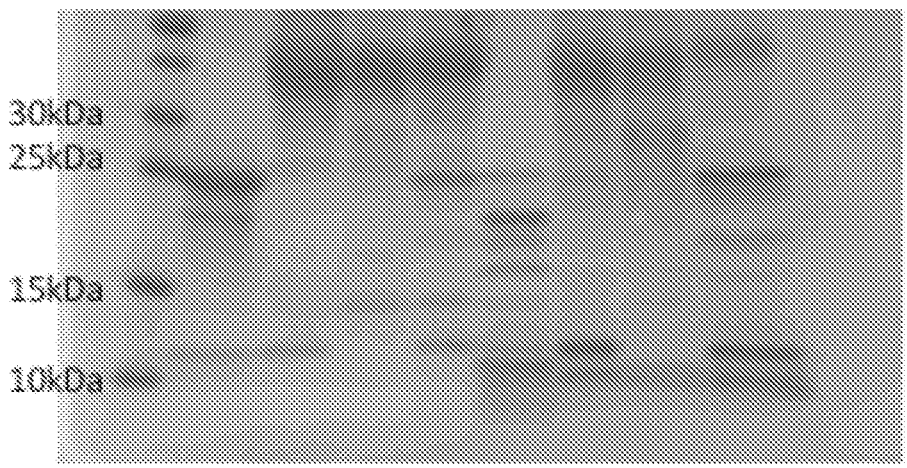

The rates of cell proliferation are presented in FIG. 5B. The ADAM10 modulating peptide of SEQ ID NO: 62 significantly reduced cell proliferation (78%) at 10 µM compared to vehicle control (see FIG. 5B).

Example 6

ADAM10 Modulating Peptide have Improved Pharmacokinetic Properties

The best candidates were taken into pharmacokinetic studies in mice. Briefly, Balb/C female mice (3/group) received a single intraperitoneal (i.p.) dose of an ADAM10 modulating peptide or vehicle control. Blood samples were taken and serum was prepared and stored at −80° C. Sera concentrations of ADAM10 modulating peptides were determined indirectly using a bioassay based on the inhibitory potency of the sera against ADAM10 enzyme activity. 2-5 µl of sera were incubated with 35 µl of 20 µM substrate, PEPDAB064 (BioZyme Inc.) containing protease inhibitors, pepstatin, AEBSF, bestatin, and E-64, 10 µl of human ADAM10, and spiked with varying concentrations of ADAM10 modulating peptides with known concentration.

The percent ADAM10 inhibition was determined in order to prepare a standard curve by using ADAM10 prodomain of known concentration into sera. 2-5 μl samples were taken and added to 45 μl of substrate solution prepared by diluting the buffer used above with the buffer that the ADAM10 modulating peptides were dissolved in (20 mM Tris buffer, pH 8, 40 mM NaCl, and 10% glycerol) at a ratio of 1:3.5. The percent inhibition was determined relative to sera taken from a control group of mice that were injected with a vehicle control.

FIGS. 6A-6D and 7 summarize the results from the experiments. Most of double furin mutants and the single furin mutant and pegylated versions had better pharmacokinetic properties than the wild type prodomain of ADAM10 (SEQ ID NO: 1). The exception was SEQ ID NO: 68, which is a mutant that was stable to furin but degraded rapidly by meprin and had similar pharmacokinetic properties to the wild type protein. The prodomain with SEQ ID NO: 63 was modified as set forth in SEQ ID NOs: 69-71 so that a cysteine could be incorporated at C151, or the N- or C-terminus. All of the pegylated versions of SEQ ID NOs: 69-71 had improved pharmacokinetic properties relative to SEQ ID NO: 63 (FIG. 7) and were more stable to furin and meprin cleavage as set forth in more detail herein below.

Example 7

Cleavage Experiments

Figure 2:
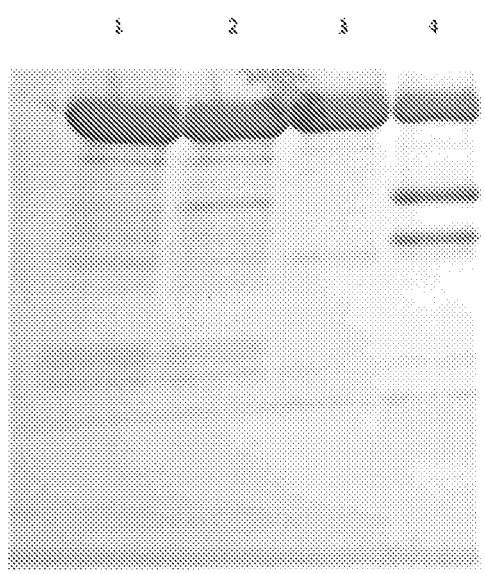
FIG. 2 is a image of a Coomassie-stained SDS-PAGE gel showing the results of furin cleavage of non-pegylated peptides of SEQ ID NO: 6 (also referred to herein as mut2) and SEQ ID NO: 1 (i.e., wild type). Lane 1 shows a SEQ ID NO: 6 negative control (i.e., no furin). Lane 2 shows SEQ ID NO: 6 plus furin. Lane 3 shows a wild type negative control (i.e., no furin). Lane 4 shows SEQ ID NO: 1 plus furin.
Figure 3:
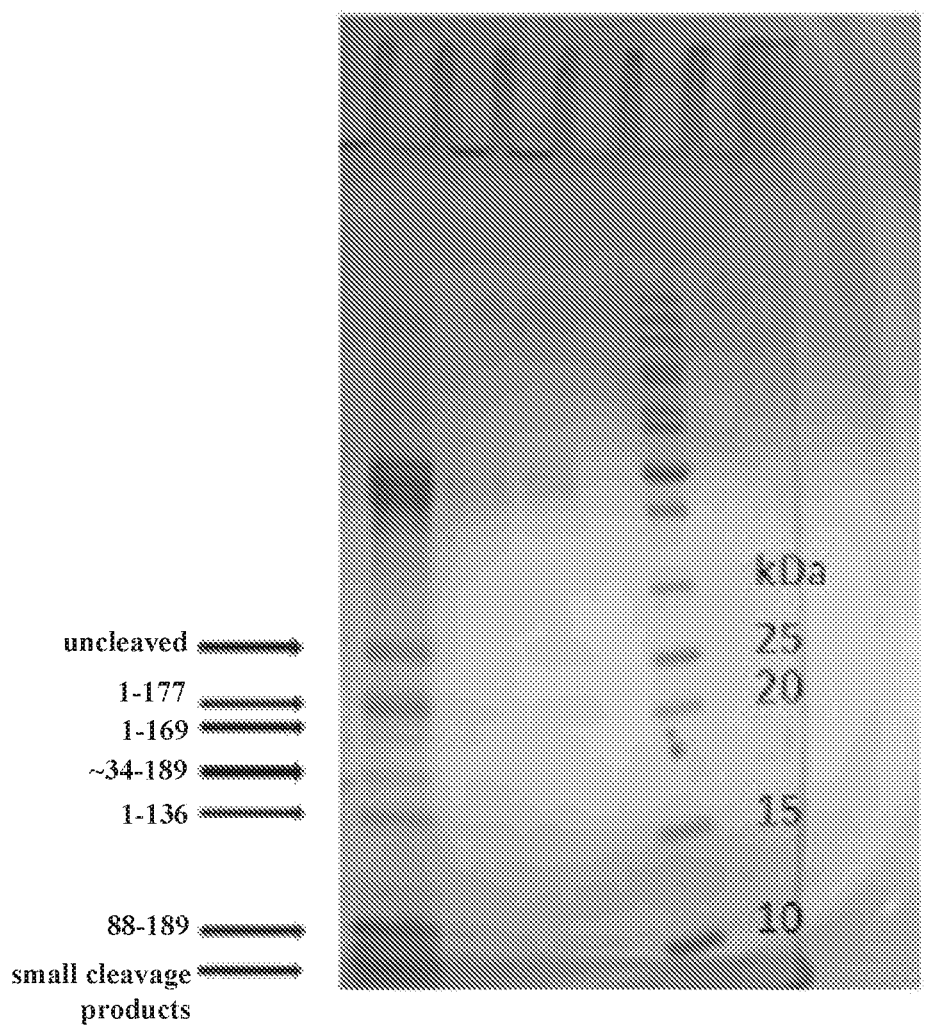
FIG. 3 is a image of a Coomassie-stained SDS-PAGE gel showing the results of meprin cleavage of SEQ ID NO: 1. Lane 1 is SEQ ID NO: 1 cleaved with meprin. Lane 2 is a negative control that includes activation buffer with furin used to activate the meprin. Lane 3 is the activation buffer with meprin. Lane 4 is blank. Lane 5 shows the positions of various molecular weight markers. There are multiple meprin recognition sites in SEQ ID NO: 1, resulting in a cleavage pattern as set forth in Lane 1. The cleaved fragments corresponded to uncleaved SEQ ID NO: 1 (uncleaved), and fragments that included amino acids 1-177 of SEQ ID NO: 1 (1-177), amino acids 1-169 of SEQ ID NO: 1 (1-169), amino acids 34/35-189 of SEQ ID NO: 1 (~34-189), amino acids 1-136 of SEQ ID NO: 1 (1-136), amino acids 88-189 of SEQ ID NO: 1 (88-189), and several smaller fragments that presumably derived from cleavage at multiple cleavage sites within SEQ ID NO: 1 (small cleavage products).
Figure 4:
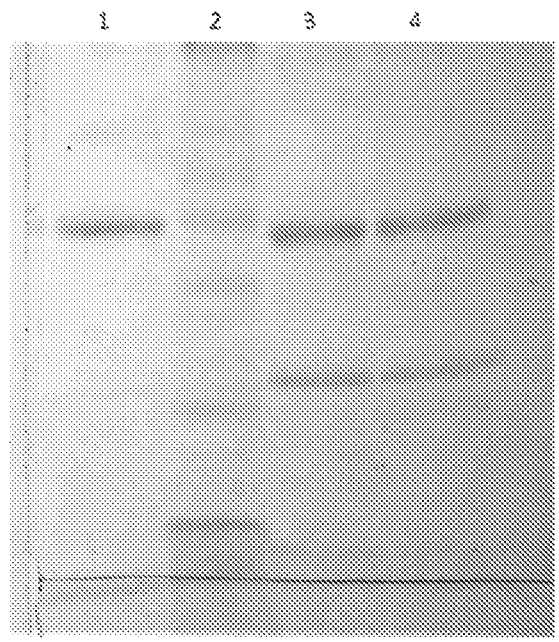
FIG. 4 is a image of a Coomassie-stained SDS-PAGE gel showing the results of meprin cleavage of SEQ ID NO: 1 or a peptide of SEQ ID NO: 9. SEQ ID NO: 9, also referred to herein as mut3, included alanine substitutions that inactivated the two furin sites of SEQ ID NO: 1 (at amino acids 28 and 54 of SEQ ID NO: 1) and alanine substitutions that inactivated two (2) meprin sites of SEQ ID NO: 1 (at amino acids 88 and 177 of SEQ ID NO: 1). Lane 1 is SEQ ID NO: 1 without meprin, Lane 2 is SEQ ID NO: 1 plus meprin. Lane 3 is SEQ ID NO: 7 without meprin. Lane 4 is SEQ ID NO: 7 plus meprin.

Meprin and furin were used to cleave prodomains of ADAM10. FIGS. 1 and 3 show that the wild type protein (SEQ ID NO: 1) was rapidly degraded by meprin and furin. Approximately 20-50 μg of wild type (WT), pegylated-WT, or an exemplary ADAM10 modulating peptide (mut2; SEQ ID NO: 6) for the furin experiment and another exemplary ADAM10 modulating peptide (mut3; SEQ ID NO: 9) for the meprin experiment in a volume of approximated 100 μl in a 1.7 ml Eppendorf tube were reacted with furin or meprin. Control samples had no meprin or no furin but were run side by side. Samples were incubated at 37° C. and a time course was run by removing approximately 20-30 μl of solution and quenching with 10 μl of a 4× solution of loading dye. Samples were run on a 16% Nowex gel and stained with Simply Blue. Results shown in FIGS. 1, 2, and 4 indicated that the mutant ADAM10 modulating peptides were resistant to cleavage by meprin and/or furin.

SEQ ID NO: 62, which is a double furin mutant, and pegylated SEQ ID NOs: 69-71 were the most resistant to furin and meprin cleavage (see FIGS. 8A-8C and FIGS. 9A-9C). Having both furin mutations stabilized SEQ ID NO: 62 also to meprin cleavage (compare SEQ ID NO: 34, a single furin mutant, to SEQ ID NO: 62 and SEQ ID NO: 63, both of which are double furin mutants in FIG. 8A).

In addition, the position of the furin mutation affected meprin cleavage. Mut2/SEQ ID NO: 6, which has the furin site modifications of RXKR>RXAR, was less resistant to furin cleavage as compared to SEQ ID NO: 62 (RXKR>RXKA) and SEQ ID NO: 63 (RXKR>RXKK). Additionally, SEQ ID NO: 62 was more stable to furin mutants containing mutations AXKR such as SEQ ID NO: 65 and SEQ ID NO: 68 (see FIG. 8B) even though the AXKR mutants were quite stable.

SEQ ID NO: 64 and SEQ ID NO: 67 have mouse ADAM10 prodomain sequences where the C-terminal tail has no meprin site at 176-178 (compare SEQ ID NO: 1 to SEQ ID NO: 2). SEQ ID NO: 67 is a mouse/human hybrid, where the human prodomain has its C-terminal tail replaced with the corresponding mouse prodomain sequence. These sequences were also much more resistant to meprin cleavage as compared to the WT (SEQ ID NO: 1), Mut2 (SEQ ID NO: 6), and SEQ ID NO: 34 (see FIGS. 9A and 9B).

Mut3/SEQ ID NO: 9 is a double meprin double furin mutant (K28A; K54A; E88A; E177A;). It was completely resistant to meprin cleavage under the experimental conditions tested (see FIG. 4). Pegylated SEQ ID NOs: 69-71, which were not very inhibitory against meprin in the fluorescence assay described above (see Table 7), were very resistant to meprin cleavage (see FIG. 9C) and furin cleavage (see FIG. 8C).

Example 8

ADAM10 Modulating Peptides Inhibit Cellular Shedding Events In Vitro and In Vivo MDA-MB-468 cells were seeded in a 96 well plate. After overnight incubation cells were washed with serum-free medium and incubated for 24 hours in starvation medium. After an additional 48-72 hours, media was removed from the cells and incubated with arrays provided from RayBiotech, Inc. of Norcross, Georgia, United States of America.

Table 8 presents the $IC_{50}$ values for inhibition of shedding of Notch1, Notch3, Jagged 1, betacellulin, and Mica A. SEQ ID NO: 62, which is much more resistant to furin and meprin cleavage as compared to Mut2/SEQ ID NO: 6 and all the other constructs, improved the $IC_{50}$ of Notch 3 over 10-fold (890 vs. 76 nM).

TABLE 8

$IC_{50}$ Values for Inhibition of Shedding of Exemplary Substrates

| Substrate | Mut2/SEQ ID NO: 6 $IC_{50}$ (nM) | SEQ ID NO: 62 $IC_{50}$ (nM) |
| --- | --- | --- |
| Notch 1 | | 607 ± 459 |
| Notch 3 | 890 ± 330 | 76 ± 44 |
| Mica A | | 98 ± 53 |
| HB-EGF | 680 ± 350 | |
| Jagged 1 | 560 ± 220 | |
| Betacellulin | 770 ± 370 | |

Media from cells treated with 5 μM SEQ ID NO: 62 vs. 5 μM SEQ ID NO: 65 were also subjected to a growth factor array from RayBiotech. Table 9 summarizes a number of factors that increased or decreased in the media relative to a vehicle control. Note that the more stable SEQ ID NO: 62 gave the highest affect in regulating factors released by cells.

TABLE 9

Percent Inhibition of Exemplary Substrates by SEQ ID NOs: 62 and 65

| Factor | % Inhibition by SEQ ID NO: 62 | % Inhibition by SEQ ID NO: 65 |
| --- | --- | --- |
| HB-EGF (known ADAM10 substrate) | 63 | 20 |
| IGF-I SR | 45 | 35 |
| AR (known ADAM17 substrate) | 0 | −48 |
| TGF beta | 76 | 10 |
| GM-CSF | 30 | 3 |
| VEGF | 50 | 0 |

Sera from vehicle or from SEQ ID NO: 62-treated animals from the pharmacokinetic experiments were taken and subjected to a 100 protein array from RayBiotech. Table 10 summarizes the statistically significant factors that were modulated by SEQ ID NO: 62 treatment relative to vehicle. Both RAGE and fractalkine, two known substrates for ADAM10 were significantly decreased in sera, indicating that a mutant prodomain can inhibit ADAM10 activity in vivo.

TABLE 10

Factors that were Statistically Significantly Modulated by SEQ ID NO: 62 Treatment Relative to Vehicle

| A10 Substrate | Inhibition (%) | SEM |
|---|---|---|
| I-TAC | 55 | 13 |
| Fractalkine | 74 | 11 |
| ALK-1 | 100 | 57 |
| Fcg RIIB | 44 | 0 |
| HGF R | 54 | 16 |
| GITR | 66 | 9 |
| RAGE | 69 | 21 |

Example 9

In Vivo Studies

Hollow fiber model. On day-1, MDA-MB-468, BT-20, and A549 cells were loaded into Hollow Fibers, placed in cell culture dishes containing medium, and were equilibrated in an incubator at 37° C., 5% $CO_2$ overnight. Tumor cells were then loaded using medium into KROSFLO® brand hollow fiber membranes. 1-2 hours before surgery mice received Meloxicam (1 mg/kg in 5 ml/kg) subcutaneously. Implantation was performed while mice were under inhalational isoflurane anesthesia. Three fibers containing either MDA-MB-468, A549, or BT-20 cells were implanted into two different compartments: subcutaneous and intraperitoneal. Therefore, every mouse received 6 fibers.

In detail, a trocar containing the fibers was inserted through a skin incision to place fibers subcutaneously and peritoneally using the same skin incision with further perforating the peritoneum. Skin was closed using suture clips. Dosing commenced using i.p. administration of SEQ ID NO: 62 at 10 mg/kg or vehicle control every three days for two weeks. Body weights were measured three times a week. On day 15 (14 days after therapy), animals were sacrificed by cervical dislocation and fibers were extracted. Each fiber was processed according to the CELLTITER-GLO® brand luminescent cell viability assay protocol described below.

CELLTITER-GLO® brand luminescent cell viability assay. Each fiber was cut into 4 pieces and directly placed into 2 ml Lysing Matrix A vials (Catalogue No. 6910, MP Biomedicals, Santa Ana, California, United States of America) containing 1 ml ex vivo Luciferase buffer (25 mM Tris-Phosphate pH 7.8, 2 mM EDTA, 2 mM DTT, 0.1% TRITON™ X-100) at 4° C. Fibers were destroyed using a FASTPREP-24® brand homogenization system (MP Biomedicals, Santa Ana, California, United States of America) for 30 seconds and 5 m/s and thereafter centrifuged at 10000 rpm and 4° C. for 10 minutes. At ambient temperature, supernatant was incubated with CELLTITER-GLO® brand luminescent cell viability assay buffer (1:10) for 10 minutes in the dark while shaking. Luminescence was detected with an EnSpire plate reader (Perkin Elmer, Waltham, Massachusetts, United States of America). Data of the individual groups were analyzed using descriptive data analysis (Mean with SEM, Median). Statistical analysis of efficacy data was done using the Mann Whitney test and the unpaired Student's t-test.

Figure 10:
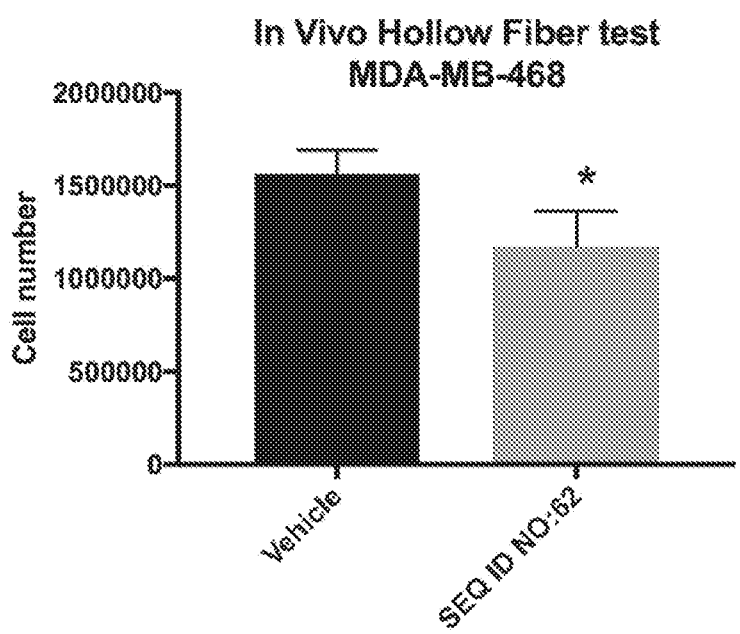
FIG. 10 is a bar graph showing the results of a Hollow Fiber Model test of SEQ ID NO: 62 versus a negative vehicle control. *: $P<0.05$. Error bars are ±standard error of the mean (SEM) calculated from samples run in sextuplicate.

The results are presented in FIG. 10. SEQ ID NO: 62 reduced proliferation of MDA-MB-468 cells in vivo by approximately 20% relative to the vehicle control.

Figure 11:
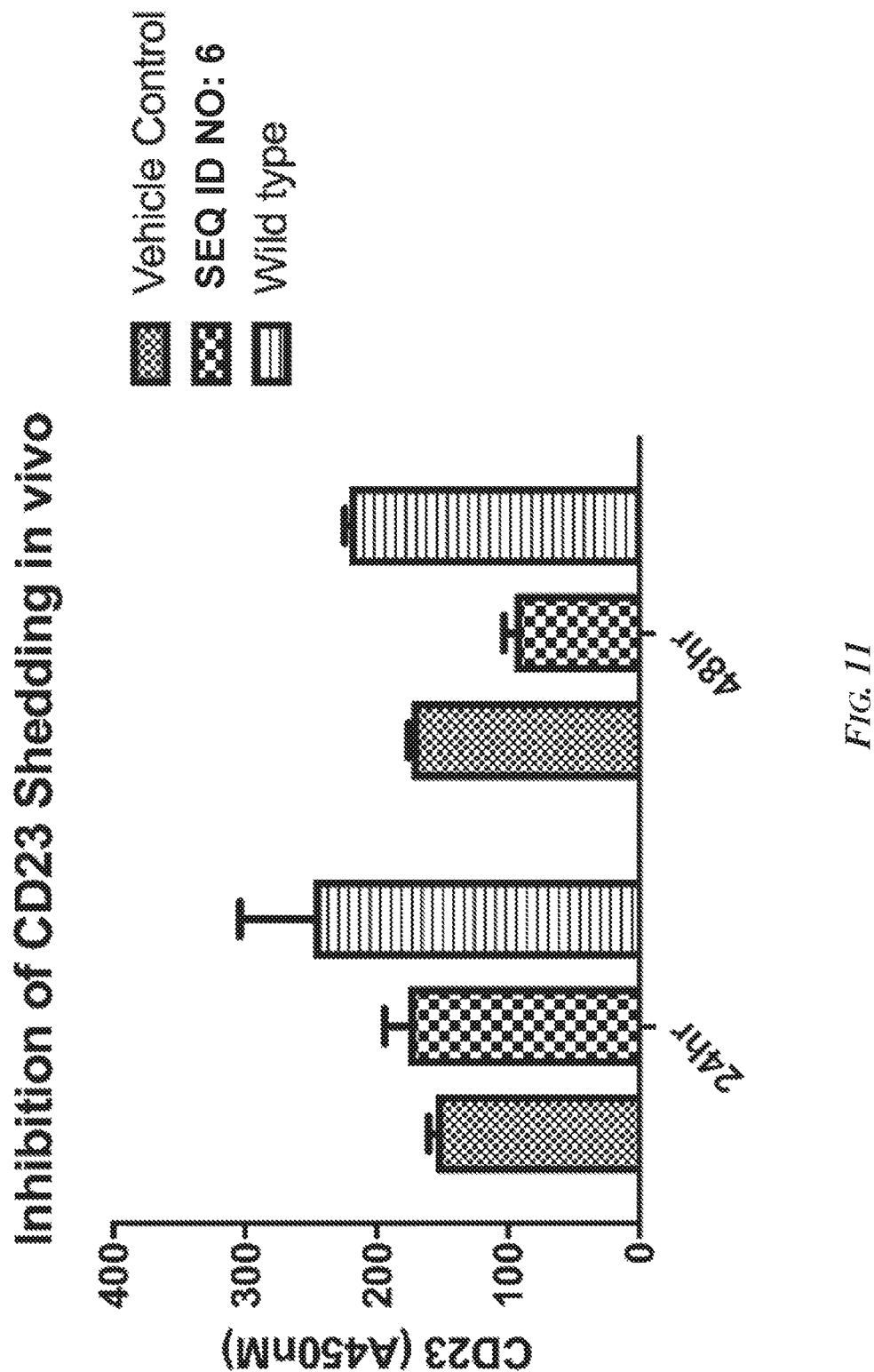
FIG. 11 is a bar graph showing the extent of inhibition of CD23 shedding in vivo at 24 and 48 hours by mut2/SEQ ID NO: 6 (middle bar of each pair) as compared to a negative vehicle control (left bar of each pair) and the wild type sequence of SEQ ID NO: 1 (right bar of each pair). Error bars are ±standard error of the mean (SEM) calculated from samples run in triplicate.

Inhibition of CD23 shedding. To determine whether the ADAM10 modulating peptides of the presently disclosed subject matter inhibited CD23 shedding in vivo, animals were dosed i.p. with either SEQ ID NO: 1 (Wild type) or Mut2/SEQ ID NO: 6. Sera was taken after 24 and 48 hours and CD23 levels were determined via ELISA. The percent inhibition of shedding relative to a vehicle control was determined, and the results are shown in FIG. 11. Mut2/SEQ ID NO: 6 inhibited CD23 shedding whereas SEQ ID NO: 1 did not, indicating that mutations at the furin sites and cysteine residues improved the ability of the prodomain to inhibit ADAM10 in vivo.

Tumor Xenograft Model. To determine whether the ADAM10 ADAM10 modulating peptides of the presently disclosed subject matter have therapeutic potential for tumor growth inhibition in vivo, efficacy studies are performed using MDA MB-468-, A549-, or HC116-derived xenograft tumor models in athymic mice. Briefly, $1 \times 10^7$ cells, are implanted s.c. into the flanks of 6-week-old female athymic nu/nu mice. Tumor sizes in two dimensions are measured with calipers, and volumes are calculated. The treatments start when the tumor size has reached approximately 200 $mm^3$. Vehicle control and ADAM10 prodomain peptide alone at two doses are given as determined from pharmacokinetic data. Each treatment group (n=6 per group) is monitored for up to 7-8 weeks. Body weights and tumors are measured twice weekly, and tumor growth and regression rates are determined. Animals are euthanized at the end of the experiment, and the liver, heart, visceral fat, kidneys, and brain are retained and examined for tissue damage and toxicity.

Once a suitable dose is found, one or more ADAM10 modulating peptides are used in combination with other cancer agents in the xenograft tumor model. Cancer agent alone or in combination with one or more ADAM10 modulating peptides are administered and the experiment is performed as described above.

Asthma model. To determine whether the ADAM10 modulating peptides of the presently disclosed subject matter have therapeutic potential in asthma, efficacy studies are performed using an ovalbumin model that is $TH_2$ dependent. Briefly, a mast cell/IgE dependent mouse model is used. This model was used previously to test other less selective small molecule ADAM10 inhibitors (Mathews et al., 2011). 10 µg ovalbumin is injected i.p. into 6 female Balb/C mice per group on days 1, 3, 5, 7, 9, 11, and 13. Pegylated ADAM10 modulating peptides (2.5 mg/kg) or a vehicle control is given intranasally or i.p. every other day or every 3 days. An ovalbumin intranasal challenge (20 µg) is given on days 40, 43, and 46. On day 47, airway resistance is measured after the final challenge. Mice are anesthetized by i.p. injection of 207 mg/kg of ketamine and 42 mg/kg of xylazine. After cannulization and paralyzation, mice are ventilated and baseline lung function is measured. Mice are then exposed to acetyl beta methylcholine chloride. Newtonian resistance, tissue damping, and tissue elastance are measured. Following determination of lung function, bronchial aveloral lavage fluid is collected and saved for cytokine and chemokine analysis. Cells are pelleted, stained, and counted to determine types and amounts present. All statistics are done using the two-tailed T test, with Bonferroni correction when multiple comparisons are made. Additionally, the maximum tolerated dose is determined through acute tolerability studies in mice. Mice are monitored daily for clinical signs of distress in response to different drug doses. Animals are euthanatized at the end of the experiment and the liver, intestines, heart, visceral fat, kidneys, and brain are retained and examined for tissue damage and toxicity.

Lupus Model. 18-22-week-old female mice (NZBWF1) from The Jackson Laboratory (Bar Horbor, Maine, United States of America) are given either vehicle control or compound i.p. after tape stripping a 3×3 cm strip on the dorsal backs of mice 10 times to induce injury and onset of CLE symptoms. Female only mice are used because male mice in this breed do not develop CLE and in humans most of the patients with CLE are female. This model has been used previously as a model for CLE (Guiducci et al., 2010). An initial experiment is done with only 5 mice before dosing to ensure CLE develops and to monitor the conditions of the mice. Once the initial experiment is complete, dosing commences. After 3 weeks of dosing every 2-3 days, scoring is done. The biopsy specimens are fixed in formalin and embedded in paraffin. Sections are stained with hematoxylin and eosin. Multiple skin sections of 11 mice per group are evaluated in a blinded fashion. The following histological features are assessed and graded from 1 to 3: (a) epidermis thickness; (b) degree of ulceration; (c) intraepithelial inflammation; (d) dermal inflammation; and (e) panniculus inflammation. Histological grading is assigned as follows: 0: normal skin architecture, few dermal leukocytes, and regular adnexa; 1: mild inflammation, slight epidermal hyperplasia, and signs of dermal fibroblast proliferation; 2: moderate inflammation, noticeable epidermal hyperplasia (two- to fourfold increase in epithelial thickness) with hyperkeratosis, significant leukocyte/neutrophil-granulocyte dermal infiltrate with few macrophages, moderate fibrosclerosis of the dermis, reduction in the number of adnexa, and slight degenerative changes of the hypodermic adipose tissue; and 3: severe inflammation, marked epidermal hyperplasia (more than fourfold increase in epithelial thickness) with hyperkeratosis, formation of keratin-filled craters and cysts, diffuse discontinuity of the epidermal layer (ulceration), extensive dermal infiltrate with abundant neutrophils and macrophages, pronounced dermal fibrosclerosis, vanishing of adnexa, and evident degenerative changes of the hypodermic adipose tissue. The different parameters are scored separately and summed to obtain a total disease score. Statistical significance among groups is calculated with a Mann-Whitney U test. In addition to testing for changes in CLE, kidney function and anti-nuclear antibody amounts are determined to also see if other lupus effects are attenuated with prodomain treatment. Urinalysis, checking for bilirubin, blood, glucose levels, ketones, pH, protein, specific gravity, urine sediment, urobilinogen and urine sediment, color, and appearance are performed. Organ weights are determined, and tissues are preserved for analysis and identification of changes in spleen, kidneys, liver, lymph nodes, mesenteric, and heart.

Example 10

ADAM10 Modulating Peptides Reduce Allergic Responses to Dust Mite Antigens

Wild type C57Bl/6 and/or Balb/c mice are intranasally exposed to 40 μL of one or more ADAM10 modulating peptides or vehicle control on days 1-3, followed by 25 μL saline or 15 μg/25 μL house dust mite antigen extract on day 4. Bronchoconstriction is assessed using a FLEXIVENT™ brand respiratory analysis system (SCIREQ® Scientific Respiratory Equipment Inc., Montreal, Quebec, Canada). Airway resistance (Rrs) is determined at increasing doses of methacholine (5, 10, 25 mg/ml) and presented as percent increase from PBS baseline.

BALF supernatants are analyzed for MUC5AC protein by ELISA as described and lung morphology is assessed for peribronchiolar perivascular inflammatory cellular infiltration.

REFERENCES

All references listed below, as well as all references cited in the instant disclosure, including but not limited to all patents, patent applications and publications thereof, scientific journal articles, and database entries (e.g., GENBANK® database entries and all annotations available therein) are incorporated herein by reference in their entireties to the extent that they supplement, explain, provide a background for, or teach methodology, techniques, and/or compositions employed herein.

Accession Nos. NP_001101.1 and NP_031425.2 of the GENBANK® biosequence database.

Altschul et al. (1990) (1990) Basic local alignment search tool. J Mol Biol 215:403-410.

Ausubel et al., eds (1989) *Current Protocols in Molecular Biology*. Wiley, New York, New York, United States of America.

Bech-Serra et al. (2006) Proteomic identification of desmoglein 2 and activated leukocyte cell adhesion molecule as substrates of ADAM17 and ADAM10 by difference gel electrophoresis. Molecular and Cellular Biology 26 (13): 5086-95.

Becker-Pauly et al. (2011) Proteomic analyses reveal an acidic prime side specificity for the astacin metalloprotease family reflected by physiological substrates. Molecular & Cellular Proteomics: MCP 10 (9): M111 009233.

Chen et al. (2007) Insulin stimulates the cleavage and release of the extracellular domain of Klotho by ADAM10 and ADAM17. Proceedings of the National Academy of Sciences of the United States of America 104 (50): 19796-801.

Chitadze et al. (2013) Shedding of endogenous MHC class I-related chain molecules A and B from different human tumor entities: heterogeneous involvement of the "a disintegrin and metalloproteases" 10 and 17. International Journal of Cancer 133 (7): 1557-66.

Crawford et al. (2009) ADAM10 as a therapeutic target for cancer and inflammation. Current Pharmaceutical Design 15 (20): 2288-99.

Dreymueller et al. (2015) ADAM-family metalloproteinases in lung inflammation: potential therapeutic targets. American Journal of Physiology Lung Cellular and Molecular Physiology 308 (4): L325-43.

Dyczynska et al. (2007) Proteolytic processing of delta-like 1 by ADAM proteases. The Journal of Biological Chemistry 282 (1): 436-44.

Edwards et al. (2008) The ADAM metalloproteinases. Molecular Aspects of Medicine 29 (5): 258-89.

Esselens et al. (2008) Metastasis-associated C4.4A, a GPI-anchored protein cleaved by ADAM10 and ADAM17. Biological Chemistry 389 (8): 1075-84.

Guiducci et al. (2010) Autoimmune skin inflammation is dependent on plasmacytoid dendritic cell activation by nucleic acids via TLR7 and TLR9. The Journal of Experimental Medicine 207 (13): 2931-42.

Hartmann et al. (2002) The disintegrin/metalloprotease ADAM 10 is essential for Notch signalling but not for α-secretase activity in fibroblasts. Human Molecular Genetics (11): 2615-24.

Henikoff & Henikoff (1992) Amino acid substitution matrices from protein blocks. Proc Natl Acad Sci USA 89: 10915-10919.

Hoashi et al. (2010) The secreted form of a melanocyte membrane-bound glycoprotein (Pmel17/gp100) is released by ectodomain shedding. FASEB Journal 24 (3): 916-30.

Jefferson et al. (2013) The substrate degradome of meprin metalloproteases reveals an unexpected proteolytic link between meprin beta and ADAM10. Cellular and Molecular Life Sciences: CMLS 70 (2): 309-33.

Karlin & Altschul (1993) Applications and statistics for multiple high-scoring segments in molecular sequences. Proc Natl Acad Sci USA 90:5873-5877.

Kawaguchi et al. (2015) ADAM protease inhibitors reduce melanogenesis by regulating PMEL17 processing in human melanocytes. Journal of Dermatological Science 78 (2): 133-42.

Kyte & Doolittle, (1982) A simple method for displaying the hydropathic character of a protein. J Mol Biol 157:105-132.

Lammich et al. (1999) Constitutive and regulated alpha-secretase cleavage of Alzheimer's amyloid precursor protein by a disintegrin metalloprotease. Proceedings of the National Academy of Sciences of the United States of America 96 (7): 3922-7.

Lemieux et al. (2007) The low affinity IgE receptor (CD23) is cleaved by the metalloproteinase ADAM10. The Journal of Biological Chemistry 282 (20): 14836-44.

Li et al. (2007) Metalloproteases regulate T-cell proliferation and effector function via LAG-3. The EMBO Journal 26 (2): 494-504.

Ludwig et al. (2005) Metalloproteinase inhibitors for the disintegrin-like metalloproteinases ADAM10 and ADAM17 that differentially block constitutive and phorbol ester-inducible shedding of cell surface molecules. Combinatorial Chemistry & High Throughput Screening 8 (2): 161-71.

Mathew et al. (2008) The Notch Ligands, Jagged and Delta, Are Sequentially Processed by α-Secretase and Presenilin/γ-Secretase and Release Signaling Fragments. Journal of Biological Chemistry (278): 34427-37.

Mathews et al. (2011) A potential new target for asthma therapy: a disintegrin and metalloprotease 10 (ADAM10) involvement in murine experimental asthma. Allergy 66 (9): 1193-200.

Moss et al. (2008) Drug insight: tumor necrosis factor-converting enzyme as a pharmaceutical target for rheumatoid arthritis. Nature Clinical Practice Rheumatology 4 (6): 300-9.

Needleman & Wunsch (1970) A general method applicable to the search for similarities in the amino acid sequence of two proteins. J Mol Biol 48:443-453.

Pearson & Lipman (1988) Assessing sequence comparison methods with reliable structurally identified distant evolutionary relationships. Proc Natl Acad Sci USA 85:2444-2448.

Pruessmeyer & Ludwig (2009) The good, the bad and the ugly substrates for ADAM10 and ADAM17 in brain pathology, inflammation and cancer. Seminars in Cell & Developmental Biology 20 (2): 164-74.

Sahin et al. (2004) Distinct roles for ADAM10 and ADAM17 in ectodomain shedding of six EGFR ligands. The Journal of Cell Biology 164 (5): 769-79.

Schelter et al. (2010) A disintegrin and metalloproteinase-10 (ADAM-10) mediates DN30 antibody-induced shedding of the met surface receptor. The Journal of Biological Chemistry 285 (34): 26335-40.

Smith & Waterman (1981) Local homologies algorithm to align sequences. Adv Appl Math 2:482-489.

U.S. Pat. No. 4,554,101.

Waldhauer et al. (2008) Tumor-Associated MICA is shed by ADAM proteases. Cancer Research (68): 6368-76.

Witters et al. (2008) Synergistic inhibition with a dual epidermal growth factor receptor/HER-2/neu tyrosine kinase inhibitor and a disintegrin and metalloprotease inhibitor. Cancer Research 68 (17): 7083-9.

Wong et al. (2015) The Functional Maturation of a Disintegrin and Metalloproteinase (ADAM) 9, 10, and 17 Requires Processing at a Newly Identified Proprotein Convertase (PC) Cleavage Site. The Journal of Biological Chemistry 290 (19): 12135-46.

Wong et al. (2016) Harnessing the natural inhibitory domain to control TNFalpha Converting Enzyme (TACE) activity in vivo. Scientific Reports 6:35598.

Zhou et al. (2006) Targeting ADAM-mediated ligand cleavage to inhibit HER3 and EGFR pathways in non-small cell lung cancer. Cancer Cell 10 (1): 39-50.

It will be understood that various details of the presently disclosed subject matter can be changed without departing from the scope of the presently disclosed subject matter. Furthermore, the foregoing description is for the purpose of illustration only, and not for the purpose of limitation.

SEQUENCE LISTING (71814 sequences)

SEQ ID NO: 1 - protein, 189 aa, Homo sapiens
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2 - protein, 190 aa, Mus musculus
NPLNKYIRHYEGLSYNVDSLHQKHQRAKRAVSHEDQFLLLDFHAHGRQFNLRMKRDTSLFSDEFKVETSNKVLDYDTSHIYTGHIYGEEGSFSHGSVIDGRFEGFIKTRGGTFYIEPAERYIKDRILPFHSVIYHEDDINYPHKYGPQGGCADHSVFERMRKYQMTGVEEGARAHPEKHAASSGPELLRK

SEQ ID NO: 3 - protein, 189 aa, Artificial Sequence
  Artificially created consensus sequence
  misc_feature (26)..(26): Xaa can be Arg, Ala, Ser, Gly, or Thr
  misc_feature (27)..(27): Xaa can be Ala, Arg, or Lys
  misc_feature (28)..(28): Xaa can be Lys, Ala, Ser, Gly, or Thr
  misc_feature (29)..(29): Xaa can be Arg, Ala, Ser, Gly, Thr, or Lys
  misc_feature (34)..(36): Xaa can be Glu, Asp, Gln, Ala, Ser, Gly, Thr, or Asn
  misc_feature (52)..(52): Xaa can be Arg, Ala, Ser, Gly, or Thr
  misc_feature (53)..(53): Xaa can be Met, Arg, or Lys
  misc_feature (54)..(54): Xaa can be Lys, Ala, Ser, Gly, or Thr
  misc_feature (55)..(55): Xaa can be Arg, Ala, Ser, Gly, Thr, or Lys
  misc_feature (62)..(63): Xaa can be Asp, Glu, Ala, Ser, Gly, Thr, or Asn
  misc_feature (88)..(89): Xaa can be Glu, Ala, Ser, Gly, Thr, or Asn
  misc_feature (136)..(138): Xaa can be Glu, Asp, Ala, Ser, Gly, Thr, or Asn
  misc_feature (151)..(151): Xaa can be Cys, Ala, Ser, Gly, or Thr
  misc_feature (169)..(170): Xaa can be Glu, Ala, Ser, Gly, Thr, or Asn
  misc_feature (176)..(178): Xaa can be Glu, Gln, Ala, Ser, Gly, Thr, or Asn
NPLNKYIRHYEGLSYNVDSLHQKHQXXXXAVSHXXXFLRLDFHAHGRHFNLXXXXDTSLFSXXFKVETSNKVLDYDTSHIYTGHIYGXXGSFSHGSVIDGRFEGFIQTRGGTFYVEPAERYIKDRTLPFHSVIYHXXXINYPHKYGPQGGXADHSVFERMRKYQMTGVXXVTQIPXXXHAANGPELLRK

SEQ ID NO: 4 - protein, 190 aa, Artificial Sequence
  Artificially created consensus sequence
  misc_feature (26)..(26): Xaa can Arg, Ala, Ser, Gly, or Thr
  misc_feature (27)..(27): Xaa can be Ala, Arg, or Lys
  misc_feature (28)..(28): Xaa can be Lys, Ala, Ser, Gly, or Thr
  misc_feature (29)..(29): Xaa can be Arg, Ala, Ser, Gly, Thr, or Lys
  misc_feature (34)..(36): Xaa can be Glu, Asp, Gln, Ala, Ser, Gly, Thr, or Asn
  misc_feature (52)..(52): Xaa can be Arg, Ala, Ser, Gly, or Thr
  misc_feature (53)..(53): Xaa can be Met, Arg, or Lys
  misc_feature (54)..(54): Xaa can be Lys, Ala, Ser, Gly, or Thr
  misc_feature (55)..(55): Xaa can be Arg, Ala, Ser, Gly, Thr, or Lys
  misc_feature (62)..(63): Xaa can be Asp, Glu, Ala, Ser, Gly, Thr, or Asn
  misc_feature (88)..(89): Xaa can be Glu, Ala, Ser, Gly, Thr, or Asn
  misc_feature (136)..(138): Xaa can be Glu, Asp, Ala, Ser, Gly, Thr, or Asn
  misc_feature (151)..(151): Xaa can be Cys, Ala, Ser, Gly, or Thr
  misc_feature (169)..(170): Xaa can be Glu, Ala, Ser, Gly, Thr, or Asn
NPLNKYIRHYEGLSYNVDSLHQKHQXXXXAVSHXXXFLLLDFHAHGRQFNLXXXXDTSLFSXXFKVETSNKVLDYDTSHIYTGHIYGXXGSFSHGSVIDGRFEGFIKTRGGTFYIEPAERYIKDRILPFHSVIYHXXXINYPHKYGPQGGXADHSVFERMRKYQMTGVXXGARAHPEKHAASSGPELLRK

SEQ ID NO: 5 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 7 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 8 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 9 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 10 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 11 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 12 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 13 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 14 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 15 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 16 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 17 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 18 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 19 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 20 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 21 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 22 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 23 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 24 - protein, 187 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYDDINYPHKYGPQGGSADHSVFERMRKYQMTGVEEVTQIPQEEHAANGPELLRK

SEQ ID NO: 25 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 26 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 27 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 28 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 29 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 30 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 31 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 32 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 33 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 34 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 35 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 36 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 37 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 38 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 39 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 40 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 41 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEEDINYPHKYGPQGGCADHSVFERMRKYQMTGVEEVTQIPQAEHAANGPELLRK

SEQ ID NO: 42 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 43 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 44 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 45 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 46 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 47 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 48 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 49 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 50 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 51 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 52 - protein, 293 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRKYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 53 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 54 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 55 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 56 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 57 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 58 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 59 - protein, 189 aa, Artificial Sequence; identical to SEQ ID NO: 26
  Artificially synthesized modified ADAM10 peptide

SEQ ID NO: 60 - protein, 189 aa, Artificial Sequence; identical to SEQ ID NO: 27
  Artificially synthesized modified ADAM10 peptide

SEQ ID NO: 61 - protein, 189 aa, Artificial Sequence; identical to SEQ ID NO: 28
  Artificially synthesized modified ADAM10 peptide

SEQ ID NO: 62 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 63 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 64 - protein, 190 aa, Artificial Sequence
  Artificially synthesized modified ADAM10 peptide
NPLNKYIRHYEGLSYNVDSLHQKHQRAKKAVSHEDQFLLLDFHAHGRQFNLRMKKDTSLFSDEFKVETSNKVLDYDTSHIYTGHIYGEEGSFSHGSVIDGRFEGFIKTRGGTFYIEPAERYIKDRILPFHSVIYHEDDINYPHKYGPQGGSADHSVFERMRKYQMTGVEEGARAHPEKHAASSGPELLRK

SEQ ID NO: 65 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 66 - protein, 189 aa, Artificial Sequence
  Artificially synthesized modified ADAM10 peptide
NPLNKYIRHYEGLSYNVDSLHQKHQAAKRAVSHEDQFLLLDFHAHGRQFNLRMKADTSLFSDEFKVETSNKVPDYDTSHIYTGHIYGEEGSFSHGSVIDGRFEGFIKTRGGTFYIEPAERYIKDRILPFHSVIYHEDDINYPHKYGPQGGSADHSVFERMRKYQMTGVEEVTQIPQAEHAANGPELLRK

SEQ ID NO: 67 - protein, 190 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEGARAHPEKHAASSGPELLRK

SEQ ID NO: 68 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 69 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 70 - protein, 192 aa, Artificial Sequence
  Artificially synthesized modified ADAM10 peptide
CGSNPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 71 - protein, 194 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRKGSGSC

SEQ ID NO: 72 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 73 - protein, 189 aa, Artificial Sequence; identical to SEQ ID NO: 57
  Artificially synthesized modified ADAM10 peptide

SEQ ID NO: 74 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 75 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 76 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 77 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 78 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 79 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 80 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 81 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 82 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 83 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 84 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 85 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 86 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 87 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 88 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 89 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 90 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 91 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 92 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 93 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 94 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 95 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 96 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 97 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 98 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 99 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 100 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 101 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 102 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 103 - protein, 189 aa, Artificial Sequence; identical to SEQ ID NO: 55
  Artificially synthesized modified ADAM10 peptide

SEQ ID NO: 104 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 105 - protein, 189 aa, Artificial Sequence; identical to SEQ ID NO: 53
  Artificially synthesized modified ADAM10 peptide

SEQ ID NO: 106 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 107 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 108 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 109 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 110 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 111 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 112 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 113 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 114 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 115 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 116 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 117 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 118 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 119 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 120 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 121 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 122 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 123 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 124 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 125 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 126 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 127 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 128 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 129 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 130 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 131 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 132 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 133 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 134 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 135 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 136 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 137 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 138 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 139 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 140 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 141 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 142 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 143 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 144 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 145 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 146 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 147 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 148 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 149 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 150 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 151 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 152 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 153 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 154 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 155 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 156 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 157 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 158 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 159 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 160 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 161 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 162 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 163 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 164 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 165 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 166 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 167 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 168 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 169 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 170 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 171 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 172 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 173 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 174 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 175 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 176 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 177 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 178 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 179 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 180 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 181 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 182 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 183 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 184 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 185 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 186 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 187 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 188 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 189 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 190 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 191 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 192 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 193 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 194 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 195 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 196 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 197 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 198 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 199 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 200 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 201 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 202 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 203 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 204 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 205 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 206 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 207 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 208 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 209 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 210 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 211 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 212 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 213 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 214 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 215 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 216 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 217 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 218 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 219 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 220 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 221 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 222 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 223 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 224 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 225 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 226 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 227 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 228 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 229 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 230 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 231 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 232 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 233 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 234 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 235 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 236 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 237 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 238 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 239 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 240 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 241 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 242 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 243 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 244 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 245 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 246 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 247 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 248 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 249 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 250 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 251 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 252 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 253 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 254 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 255 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 256 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 257 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 258 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 259 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 260 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 261 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 262 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 263 - protein, 189 aa, Artificial Sequence; identical to SEQ ID NO: 27
  Artificially synthesized modified ADAM10 peptide

SEQ ID NO: 264 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 265 - protein, 189 aa, Artificial Sequence; identical to SEQ ID NO: 35
  Artificially synthesized modified ADAM10 peptide

SEQ ID NO: 266 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 267 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 268 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 269 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 270 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 271 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 272 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 273 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 274 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 275 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 276 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 277 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 278 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 279 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 280 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 281 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 282 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 283 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 284 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 285 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 286 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 287 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 288 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 289 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 290 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 291 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 292 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 293 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 294 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 295 - protein, 189 aa, Artificial Sequence; identical to SEQ ID NO: 31
  Artificially synthesized modified ADAM10 peptide

SEQ ID NO: 296 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 297 - protein, 189 aa, Artificial Sequence; identical to SEQ ID NO: 43
  Artificially synthesized modified ADAM10 peptide

SEQ ID NO: 298 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 299 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 300 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 301 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 302 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 303 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 304 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 305 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 306 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 307 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 308 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 309 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 310 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 311 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 312 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 313 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 314 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 315 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 316 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 317 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 318 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 319 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 320 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 321 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 322 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 323 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 324 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 325 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 326 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 327 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 328 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 329 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 330 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 331 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 332 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 333 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 334 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 335 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 336 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 337 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 338 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 339 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 340 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 341 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 342 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 343 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 344 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 345 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 346 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 347 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 348 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 349 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 350 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 351 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 352 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 353 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 354 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 355 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 356 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 357 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 358 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 359 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 360 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 361 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 362 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 363 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 364 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 365 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 366 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 367 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 368 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 369 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 370 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 371 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 372 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 373 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 374 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 375 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 376 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 377 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 378 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 379 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 380 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 381 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 382 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 383 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 384 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 385 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 386 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 387 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 388 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 389 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 390 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 391 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 392 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 393 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 394 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 395 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 396 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 397 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 398 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 399 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 400 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 401 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 402 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 403 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 404 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 405 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 406 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 407 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 408 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 409 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 410 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 411 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 412 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 413 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 414 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 415 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 416 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 417 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 418 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 419 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 420 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 421 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 422 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 423 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 424 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 425 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 426 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 427 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 428 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 429 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 430 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 431 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 432 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 433 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 434 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 435 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 436 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 437 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 438 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 439 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 440 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 441 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 442 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 443 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 444 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 445 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 446 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 447 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 448 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 449 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 450 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 451 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 452 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 453 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 454 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 455 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 456 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 457 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 458 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 459 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 460 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 461 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 462 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 463 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 464 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 465 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 466 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 467 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 468 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 469 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 470 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 471 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 472 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 473 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 474 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 475 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 476 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 477 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 478 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 479 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 480 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 481 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 482 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 483 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 484 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 485 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 486 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 487 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 488 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 489 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 490 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 491 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 492 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 493 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 494 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 495 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 496 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 497 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 498 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 499 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 500 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 501 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 502 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 503 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 504 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 505 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 506 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 507 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 508 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 509 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 510 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 511 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 512 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 513 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 514 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 515 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 516 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 517 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 518 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 519 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 520 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 521 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 522 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 523 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 524 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 525 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 526 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 527 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 528 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 529 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 530 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 531 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 532 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 533 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 534 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 535 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 536 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 537 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 538 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 539 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 540 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 541 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 542 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 543 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 544 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 545 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 546 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 547 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 548 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 549 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 550 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 551 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 552 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 553 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 554 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 555 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 556 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 557 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 558 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 559 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 560 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 561 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 562 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 563 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 564 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 565 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 566 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 567 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 568 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 569 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 570 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 571 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 572 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 573 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 574 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 575 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 576 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 577 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 578 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 579 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 580 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 581 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 582 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 583 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 584 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 585 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 586 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 587 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 588 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 589 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 590 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 591 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 592 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 593 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 594 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 595 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 596 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 597 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 598 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 599 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 600 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 601 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 602 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 603 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 604 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 605 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 606 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 607 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 608 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 609 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 610 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 611 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 612 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 613 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 614 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 615 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 616 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 617 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 618 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 619 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 620 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 621 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 622 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 623 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 624 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 625 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 626 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 627 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 628 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 629 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 630 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 631 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 632 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 633 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 634 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 635 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 636 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 637 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 638 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 639 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 640 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 641 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 642 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 643 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 644 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 645 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 646 - protein, 189 aa, Artificial Sequence
  Artificially synthesized modified ADAM10 peptide
NPLNKYIRHYEGLSYNVDSLHQKHQRAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 655 - protein, 189 aa, Artificial Sequence; identical to SEQ ID NO: 26
  Artificially synthesized modified ADAM10 peptide

SEQ ID NO: 656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 657 - protein, 189 aa, Artificial Sequence; identical to SEQ ID NO: 34
  Artificially synthesized modified ADAM10 peptide

SEQ ID NO: 658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 687 - protein, 189 aa, Artificial Sequence; identical to SEQ ID NO: 30
  Artificially synthesized modified ADAM10 peptide

SEQ ID NO: 688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 689 - protein, 189 aa, Artificial Sequence; identical to SEQ ID NO: 42
  Artificially synthesized modified ADAM10 peptide

SEQ ID NO: 690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 721 - protein, 189 aa, Artificial Sequence; identical to SEQ ID NO: 62
  Artificially synthesized modified ADAM10 peptide

SEQ ID NO: 722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 879 - protein, 189 aa, Artificial Sequence; identical to SEQ ID NO: 20
  Artificially synthesized modified ADAM10 peptide

SEQ ID NO: 880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1223 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1224 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1225 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1226 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1227 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1228 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1229 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1230 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1231 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1232 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1233 - protein, 189 aa, Artificial Sequence; identical to SEQ ID NO: 58
  Artificially synthesized modified ADAM10 peptide

SEQ ID NO: 1234 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1235 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1236 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1237 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1238 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1239 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1240 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1241 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1242 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1243 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1244 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1245 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1246 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1247 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1248 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1249 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1250 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1251 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1252 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1253 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1254 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1255 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1256 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1257 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1258 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1259 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1260 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1261 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1262 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1263 - protein, 189 aa, Artificial Sequence; identical to SEQ ID NO: 56
  Artificially synthesized modified ADAM10 peptide

SEQ ID NO: 1264 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1265 - protein, 189 aa, Artificial Sequence; identical to SEQ ID NO: 54
  Artificially synthesized modified ADAM10 peptide

SEQ ID NO: 1266 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1267 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1268 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1269 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1270 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1271 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1272 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1273 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1274 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1275 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1276 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1277 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1278 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1279 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1280 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1281 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1282 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1283 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1284 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1285 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1286 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1287 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1288 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1289 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1290 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1291 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1292 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1293 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1294 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1295 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1296 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1297 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1298 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1299 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1300 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1301 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1302 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1303 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1304 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1305 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1306 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1307 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1308 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1309 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1310 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1311 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1312 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1313 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1314 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1315 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1316 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1317 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1318 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1319 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1320 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1321 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1322 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1323 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1324 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1325 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1326 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1327 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1328 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1329 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1330 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1331 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1332 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1333 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1334 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1335 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1336 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1337 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1338 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1339 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1340 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1341 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1342 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1343 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1344 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1345 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1346 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1347 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1348 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1349 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1350 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1351 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1352 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1353 - protein, 189 aa, Artificial Sequence; identical to SEQ ID NO: 69
  Artificially synthesized modified ADAM10 peptide

SEQ ID NO: 1354 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1355 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1356 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1357 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1358 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1359 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1360 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1361 - protein, 189 aa, Artificial Sequence; identical to SEQ ID NO: 63
  Artificially synthesized modified ADAM10 peptide

SEQ ID NO: 1362 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1363 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1364 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1365 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1366 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1367 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1368 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1369 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1370 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1371 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1372 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1373 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1374 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1375 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1376 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1377 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1378 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1379 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1380 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1381 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1382 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1383 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1384 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1385 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1386 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1387 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1388 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1389 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1390 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1391 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1392 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1393 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1394 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1395 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1396 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1397 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1398 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1399 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1400 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1401 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1402 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1403 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1404 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1405 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1406 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1407 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1408 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1409 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1410 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1411 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1412 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1413 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1414 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1415 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1416 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1417 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1418 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1419 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1420 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1421 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1422 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1423 - protein, 189 aa, Artificial Sequence; identical to SEQ ID NO: 28
  Artificially synthesized modified ADAM10 peptide

SEQ ID NO: 1424 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1425 - protein, 189 aa, Artificial Sequence; identical to SEQ ID NO: 36
  Artificially synthesized modified ADAM10 peptide

SEQ ID NO: 1426 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1427 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1428 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1429 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1430 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1431 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1432 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1433 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1434 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1435 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1436 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1437 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1438 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1439 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1440 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1441 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1442 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1443 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1444 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1445 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1446 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1447 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1448 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1449 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1450 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1451 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1452 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1453 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1454 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1455 - protein, 189 aa, Artificial Sequence; identical to SEQ ID NO: 32
  Artificially synthesized modified ADAM10 peptide

SEQ ID NO: 1456 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1457 - protein, 189 aa, Artificial Sequence; identical to SEQ ID NO: 44
  Artificially synthesized modified ADAM10 peptide

SEQ ID NO: 1458 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1459 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1460 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1461 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1462 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1463 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1464 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1465 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1466 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1467 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1468 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1469 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1470 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1471 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1472 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1473 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1474 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1475 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1476 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1477 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1478 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1479 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1480 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1481 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1482 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1483 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1484 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1485 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1486 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1487 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1488 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1489 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1490 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1491 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1492 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1493 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1494 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1495 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1496 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1497 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1498 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1499 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1500 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1501 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1502 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1503 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1504 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1505 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1506 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1507 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1508 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1509 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1510 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1511 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1512 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1513 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1514 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1515 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1516 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1517 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1518 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1519 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1520 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1521 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1522 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1523 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1524 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1525 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1526 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1527 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1528 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1529 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1530 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1531 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1532 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1533 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1534 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1535 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1536 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1537 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1538 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1539 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1540 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1541 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1542 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1543 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1544 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1545 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1546 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1547 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1548 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1549 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1550 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1551 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1552 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1553 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1554 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1555 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1556 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1557 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1558 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1559 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1560 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1561 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1562 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1563 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1564 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1565 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1566 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1567 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1568 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1569 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1570 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1571 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1572 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1573 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1574 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1575 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1576 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1577 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1578 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1579 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1580 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1581 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1582 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1583 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1584 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1585 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1586 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1587 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1588 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1589 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1590 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1591 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1592 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1593 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1594 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1595 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1596 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1597 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1598 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1599 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1600 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1601 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1602 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1603 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1604 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1605 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1606 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1607 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1608 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1609 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1610 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1611 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1612 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1613 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1614 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1615 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1616 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1617 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1618 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1619 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1620 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1621 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1622 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1623 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1624 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1625 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1626 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1627 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1628 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1629 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1630 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1631 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1632 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1633 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1634 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1635 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1636 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1637 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1638 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1639 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1640 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1641 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1642 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1643 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1644 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1645 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1646 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1647 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1648 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1649 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1650 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1651 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1652 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1653 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1654 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1655 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1656 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1657 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1658 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1659 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1660 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1661 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1662 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1663 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1664 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1665 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1666 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1667 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1668 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1669 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1670 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1671 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1672 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1673 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1674 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1675 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1676 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1677 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1678 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1679 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1680 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1681 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1682 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1683 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1684 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1685 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1686 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1687 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1688 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1689 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1690 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1691 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1692 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1693 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1694 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1695 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1696 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1697 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1698 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1699 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1700 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1701 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1702 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1703 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1704 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1705 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1706 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1707 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1708 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1709 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1710 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1711 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1712 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1713 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1714 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1715 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1716 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1717 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1718 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1719 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1720 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1721 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1722 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1723 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1724 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1725 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1726 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1727 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1728 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1729 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1730 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1731 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1732 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1733 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1734 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1735 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1736 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1737 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1738 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1739 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1740 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1741 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1742 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1743 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1744 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1745 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1746 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1747 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1748 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1749 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1750 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1751 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1752 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1753 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1754 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1755 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1756 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1757 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1758 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1759 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1760 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1761 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1762 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1763 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1764 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1765 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1766 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1767 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1768 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1769 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1770 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1771 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1772 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1773 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1774 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1775 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1776 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1777 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1778 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1779 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1780 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1781 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1782 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1783 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1784 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1785 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1786 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1787 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1788 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1789 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1790 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1791 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1792 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1793 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1794 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1795 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1796 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1797 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1798 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1799 - protein, 189 aa, Artificial Sequence; identical to SEQ ID NO: 25
  Artificially synthesized modified ADAM10 peptide

SEQ ID NO: 1800 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1801 - protein, 189 aa, Artificial Sequence; identical to SEQ ID NO: 33
  Artificially synthesized modified ADAM10 peptide

SEQ ID NO: 1802 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1803 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1804 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1805 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1806 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1807 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1808 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1809 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1810 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1811 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1812 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1813 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1814 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1815 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1816 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1817 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1818 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1819 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1820 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1821 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1822 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1823 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1824 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1825 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1826 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1827 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1828 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1829 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1830 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1831 - protein, 189 aa, Artificial Sequence; identical to SEQ ID NO: 29
  Artificially synthesized modified ADAM10 peptide

SEQ ID NO: 1832 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1833 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1834 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1835 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1836 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1837 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1838 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1839 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1840 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1841 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1842 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1843 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1844 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1845 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1846 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1847 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1848 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1849 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1850 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1851 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1852 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1853 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1854 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1855 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1856 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1857 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1858 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1859 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1860 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1861 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1862 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1863 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1864 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1865 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1866 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1867 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1868 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1869 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1870 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1871 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1872 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1873 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1874 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1875 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1876 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1877 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1878 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1879 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1880 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1881 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1882 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1883 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1884 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1885 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1886 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1887 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1888 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1889 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1890 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1891 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1892 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1893 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1894 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1895 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1896 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1897 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1898 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1899 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1900 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1901 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1902 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1903 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1904 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1905 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1906 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1907 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1908 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1909 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1910 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1911 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1912 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1913 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1914 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1915 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1916 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1917 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1918 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1919 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1920 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1921 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1922 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1923 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1924 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1925 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1926 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1927 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1928 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1929 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1930 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1931 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1932 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1933 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1934 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1935 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1936 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1937 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1938 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1939 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1940 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1941 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1942 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1943 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1944 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1945 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1946 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1947 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1948 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1949 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1950 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1951 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1952 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1953 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1954 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1955 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1956 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1957 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1958 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1959 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1960 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1961 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1962 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1963 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1964 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1965 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1966 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1967 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1968 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1969 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1970 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1971 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1972 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1973 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1974 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1975 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 1976 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1977 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 1978 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1979 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1980 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1981 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1982 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1983 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 1984 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 1985 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 1986 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 1987 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 1988 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 1989 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 1990 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 1991 - protein, 189 aa, Artificial Sequence; identical to SEQ ID NO: 5
  Artificially synthesized modified ADAM10 peptide

SEQ ID NO: 1992 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 1993 - protein, 189 aa, Artificial Sequence; identical to SEQ ID NO: 21
  Artificially synthesized modified ADAM10 peptide

SEQ ID NO: 1994 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 1995 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 1996 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 1997 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 1998 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 1999 - protein, 189 aa, Artificial Sequence; identical to SEQ ID NO: 6
  Artificially synthesized modified ADAM10 peptide

SEQ ID NO: 2000 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2001 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2002 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2003 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2004 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2005 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2006 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2007 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2008 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2009 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2010 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2011 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2012 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2013 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2014 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2015 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2016 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2017 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2018 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2019 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2020 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2021 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2022 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2023 - protein, 189 aa, Artificial Sequence; identical to SEQ ID NO: 19
  Artificially synthesized modified ADAM10 peptide

SEQ ID NO: 2024 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2025 - protein, 189 aa, Artificial Sequence; identical to SEQ ID NO: 9
  Artificially synthesized modified ADAM10 peptide

SEQ ID NO: 2026 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2027 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2028 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2029 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2030 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2031 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2032 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2033 - protein, 189 aa, Artificial Sequence; identical to SEQ ID NO: 11
  Artificially synthesized modified ADAM10 peptide

SEQ ID NO: 2034 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2035 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2036 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2037 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2038 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2039 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2040 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2041 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2042 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2043 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2044 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2045 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2046 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2047 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2048 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2049 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2050 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2051 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2052 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2053 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2054 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2055 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2056 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2057 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2058 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2059 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2060 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2061 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2062 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2063 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2064 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2065 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2066 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2067 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2068 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2069 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2070 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2071 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2072 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2073 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2074 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2075 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2076 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2077 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2078 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2079 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2080 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2081 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2082 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2083 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2084 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2085 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2086 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2087 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2088 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2089 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2090 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2091 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2092 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2093 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2094 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2095 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2096 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2097 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2098 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2099 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2100 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2101 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2102 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2103 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2104 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2105 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2106 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2107 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2108 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2109 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2110 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2111 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2112 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2113 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2114 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2115 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2116 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2117 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2118 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2119 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2120 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2121 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2122 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2123 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2124 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2125 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2126 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2127 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2128 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2129 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2130 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2131 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2132 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2133 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2134 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2135 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2136 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2137 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2138 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2139 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2140 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2141 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2142 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2143 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2144 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2145 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2146 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2147 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2148 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2149 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2150 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2151 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2152 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2153 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2154 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2155 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2156 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2157 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2158 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2159 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2160 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2161 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2162 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2163 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2164 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2165 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2166 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2167 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2168 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2169 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2170 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2171 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2172 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2173 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2174 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2175 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2176 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2177 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2178 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2179 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2180 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2181 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2182 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2183 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2184 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2185 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2186 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2187 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2188 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2189 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2190 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2191 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2192 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2193 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2194 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2195 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2196 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2197 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2198 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2199 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2200 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2201 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2202 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2203 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2204 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2205 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2206 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2207 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2208 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2209 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2210 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2211 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2212 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2213 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2214 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2215 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2216 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2217 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2218 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2219 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2220 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2221 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2222 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2223 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2224 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2225 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2226 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2227 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2228 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2229 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2230 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2231 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2232 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2233 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2234 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2235 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2236 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2237 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2238 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2239 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2240 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2241 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2242 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2243 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2244 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2245 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2246 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2247 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2248 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2249 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2250 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2251 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2252 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2253 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2254 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2255 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2256 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2257 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2258 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2259 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2260 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2261 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2262 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2263 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2264 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2265 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2266 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2267 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2268 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2269 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2270 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2271 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2272 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2273 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2274 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2275 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2276 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2277 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2278 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2279 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2280 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2281 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2282 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2283 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2284 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2285 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2286 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2287 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2288 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2289 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2290 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2291 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2292 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2293 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2294 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2295 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2296 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2297 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2298 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2299 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2300 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2301 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2302 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2303 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2304 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2305 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2306 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2307 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2308 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2309 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2310 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2311 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2312 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2313 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2314 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2315 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2316 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2317 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2318 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2319 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2320 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2321 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2322 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2323 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2324 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2325 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2326 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2327 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2328 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2329 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2330 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2331 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2332 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2333 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2334 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2335 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2336 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2337 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2338 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2339 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2340 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2341 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2342 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2343 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2344 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2345 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2346 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2347 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2348 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2349 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2350 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2351 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2352 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2353 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2354 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2355 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2356 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2357 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2358 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2359 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2360 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2361 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2362 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2363 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2364 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2365 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2366 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2367 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2368 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2369 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2370 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2371 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2372 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2373 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2374 - protein, 189 aa, Artificial Sequence
  Artificially synthesized modified ADAM10 peptide
NPLNKYIRHYEGLSYNVDSLHQKHQRAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2375 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2376 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2377 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2378 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2379 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2380 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2381 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2382 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2383 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2384 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2385 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2386 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2387 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2388 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2389 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2390 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2391 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2392 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2393 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2394 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2395 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2396 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2397 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2398 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2399 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2400 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2401 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2402 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2403 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2404 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2405 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2406 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2407 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2408 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2409 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2410 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2411 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2412 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2413 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2414 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2415 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2416 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2417 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2418 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2419 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2420 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2421 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2422 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2423 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2424 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2425 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2426 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2427 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2428 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2429 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2430 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2431 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2432 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2433 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2434 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2435 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2436 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2437 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2438 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2439 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2440 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2441 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2442 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2443 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2444 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2445 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2446 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2447 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2448 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2449 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2450 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2451 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2452 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2453 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2454 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2455 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2456 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2457 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2458 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2459 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2460 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2461 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2462 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2463 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2464 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2465 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2466 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2467 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2468 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2469 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2470 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2471 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2472 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2473 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2474 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2475 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2476 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2477 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2478 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2479 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2480 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2481 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2482 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2483 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2484 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2485 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2486 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2487 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2488 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2489 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2490 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2491 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2492 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2493 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2494 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2495 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2496 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2497 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2498 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2499 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2500 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2501 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2502 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2503 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2504 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2505 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2506 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2507 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2508 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2509 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2510 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2511 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2512 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2513 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2514 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2515 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2516 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2517 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2518 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2519 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2520 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2521 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2522 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2523 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2524 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2525 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2526 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2527 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2528 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2529 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2530 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2531 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2532 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2533 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2534 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2535 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2536 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2537 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2538 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2539 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2540 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2541 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2542 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2543 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2544 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2545 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2546 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2547 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2548 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2549 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2550 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2551 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2552 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2553 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2554 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2555 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2556 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2557 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2558 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2559 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2560 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2561 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2562 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2563 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2564 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2565 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2566 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2567 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2568 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2569 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2570 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2571 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2572 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2573 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2574 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2575 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2576 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2577 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2578 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2579 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2580 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2581 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2582 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2583 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2584 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2585 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2586 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2587 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2588 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2589 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2590 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2591 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2592 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2593 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2594 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2595 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2596 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2597 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2598 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2599 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2600 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2601 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2602 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2603 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2604 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2605 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2606 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2607 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2608 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2609 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2610 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2611 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2612 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2613 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2614 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2615 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2616 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2617 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2618 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2619 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2620 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2621 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2622 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2623 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2624 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2625 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2626 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2627 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2628 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2629 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2630 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2631 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2632 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2633 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2634 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2635 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2636 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2637 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2638 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2639 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2640 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2641 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2642 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2643 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2644 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2645 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2646 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2647 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2648 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2649 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2650 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2651 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2652 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2653 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2654 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2655 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2656 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2657 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2658 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2659 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2660 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2661 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2662 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2663 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2664 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2665 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2666 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2667 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2668 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2669 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2670 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2671 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2672 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2673 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2674 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2675 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2676 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2677 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2678 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2679 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2680 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2681 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2682 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2683 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2684 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2685 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2686 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2687 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2688 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2689 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2690 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2691 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2692 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2693 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2694 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2695 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2696 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2697 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2698 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2699 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2700 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2701 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2702 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2703 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2704 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2705 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2706 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2707 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2708 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2709 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2710 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2711 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2712 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2713 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2714 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2715 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2716 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2717 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2718 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2719 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2720 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2721 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2722 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2723 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2724 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2725 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2726 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2727 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2728 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2729 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2730 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2731 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2732 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2733 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2734 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2735 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2736 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2737 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2738 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2739 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2740 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2741 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2742 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2743 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2744 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2745 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2746 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2747 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2748 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2749 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2750 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2751 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2752 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2753 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2754 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2755 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2756 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2757 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2758 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2759 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2760 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2761 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2762 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2763 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2764 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2765 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2766 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2767 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2768 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2769 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2770 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2771 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2772 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2773 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2774 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2775 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2776 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2777 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2778 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2779 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2780 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2781 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2782 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2783 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2784 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2785 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2786 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2787 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2788 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2789 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2790 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2791 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2792 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2793 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2794 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2795 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2796 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2797 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2798 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2799 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2800 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2801 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2802 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2803 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2804 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2805 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2806 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2807 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2808 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2809 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2810 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2811 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2812 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2813 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2814 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2815 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2816 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2817 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2818 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2819 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2820 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2821 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2822 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2823 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2824 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2825 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2826 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2827 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2828 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2829 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2830 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2831 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2832 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2833 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2834 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2835 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2836 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2837 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2838 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2839 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2840 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2841 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2842 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2843 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2844 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2845 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2846 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2847 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2848 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2849 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2850 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2851 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2852 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2853 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2854 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2855 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2856 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2857 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2858 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2859 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2860 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2861 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2862 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2863 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2864 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2865 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2866 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2867 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2868 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2869 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2870 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2871 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2872 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2873 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2874 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2875 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2876 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2877 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2878 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2879 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2880 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2881 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2882 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2883 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2884 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2885 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2886 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2887 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2888 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2889 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2890 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2891 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2892 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2893 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2894 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2895 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2896 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2897 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2898 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2899 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2900 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2901 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2902 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2903 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2904 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2905 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2906 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2907 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2908 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2909 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2910 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2911 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2912 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2913 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2914 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2915 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2916 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2917 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2918 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2919 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2920 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2921 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2922 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2923 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2924 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2925 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2926 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2927 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2928 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2929 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2930 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2931 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2932 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2933 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2934 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2935 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2936 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2937 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2938 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2939 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2940 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2941 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2942 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2943 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2944 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2945 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2946 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2947 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2948 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2949 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2950 - protein, 189 aa, Artificial Sequence
  Artificially synthesized modified ADAM10 peptide
NPLNKYIRHYEGLSYNVDSLHQKHQRAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2951 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2952 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2953 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2954 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2955 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2956 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2957 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2958 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2959 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2960 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2961 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2962 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2963 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2964 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2965 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2966 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2967 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2968 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2969 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2970 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2971 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2972 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2973 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2974 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2975 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2976 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2977 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2978 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2979 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2980 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2981 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2982 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2983 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 2984 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 2985 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 2986 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 2987 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 2988 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 2989 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 2990 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 2991 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 2992 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 2993 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 2994 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 2995 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 2996 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 2997 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 2998 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 2999 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3000 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3001 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3002 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3003 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3004 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3005 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3006 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3007 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3008 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3009 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3010 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3011 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3012 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3013 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3014 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3015 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3016 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3017 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3018 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3019 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3020 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3021 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3022 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3023 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3024 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3025 - protein, 189 aa, Artificial Sequence; identical to SEQ ID NO: 68
  Artificially synthesized modified ADAM10 peptide

SEQ ID NO: 3026 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3027 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3028 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3029 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3030 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3031 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3032 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3033 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3034 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3035 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3036 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3037 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3038 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3039 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3040 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3041 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3042 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3043 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3044 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3045 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3046 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3047 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3048 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3049 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3050 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3051 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3052 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3053 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3054 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3055 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3056 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3057 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3058 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3059 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3060 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3061 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3062 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3063 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3064 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3065 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3066 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3067 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3068 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3069 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3070 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3071 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3072 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3073 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3074 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3075 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3076 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3077 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3078 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3079 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3080 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3081 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3082 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3083 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3084 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3085 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3086 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3087 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3088 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3089 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3090 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3091 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3092 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3093 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3094 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3095 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3096 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3097 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3098 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3099 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3100 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3101 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3102 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3103 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3104 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3105 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3106 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3107 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3108 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3109 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3110 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3111 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3112 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3113 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3114 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3115 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3116 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3117 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3118 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3119 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3120 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3121 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3122 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3123 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3124 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3125 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3126 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3127 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3128 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3129 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3130 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3131 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3132 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3133 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3134 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3135 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3136 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3137 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3138 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3139 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3140 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3141 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3142 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3143 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3144 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3145 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3146 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3147 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3148 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3149 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3150 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3151 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3152 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3153 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3154 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3155 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3156 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3157 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3158 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3159 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3160 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3161 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3162 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3163 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3164 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3165 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3166 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3167 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3168 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3169 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3170 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3171 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3172 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3173 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3174 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3175 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3176 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3177 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3178 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3179 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3180 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3181 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3182 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3183 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3184 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3185 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3186 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3187 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3188 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3189 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3190 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3191 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3192 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3193 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3194 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3195 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3196 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3197 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3198 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3199 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3200 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3201 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3202 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3203 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3204 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3205 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3206 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3207 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3208 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3209 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3210 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3211 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3212 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3213 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3214 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3215 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3216 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3217 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3218 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3219 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3220 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3221 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3222 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3223 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3224 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3225 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3226 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3227 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3228 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3229 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3230 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3231 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3232 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3233 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3234 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3235 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3236 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3237 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3238 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3239 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3240 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3241 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3242 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3243 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3244 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3245 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3246 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3247 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3248 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3249 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3250 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3251 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3252 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3253 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3254 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3255 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3256 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3257 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3258 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3259 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3260 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3261 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3262 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3263 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3264 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3265 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3266 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3267 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3268 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3269 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3270 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3271 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3272 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3273 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3274 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3275 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3276 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3277 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3278 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3279 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3280 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3281 - protein, 189 aa, Artificial Sequence; identical to SEQ ID NO: 65
  Artificially synthesized modified ADAM10 peptide

SEQ ID NO: 3282 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3283 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3284 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3285 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3286 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3287 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3288 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3289 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3290 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3291 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3292 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3293 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3294 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3295 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3296 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3297 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3298 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3299 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3300 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3301 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3302 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3303 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3304 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3305 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3306 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3307 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3308 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3309 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3310 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3311 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3312 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3313 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3314 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3315 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3316 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3317 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3318 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3319 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3320 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3321 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3322 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3323 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3324 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3325 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3326 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3327 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3328 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3329 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3330 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3331 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3332 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3333 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3334 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3335 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3336 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3337 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3338 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3339 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3340 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3341 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3342 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3343 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3344 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3345 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3346 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3347 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3348 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3349 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3350 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3351 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3352 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3353 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3354 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3355 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3356 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3357 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3358 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3359 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3360 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3361 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3362 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3363 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3364 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3365 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3366 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3367 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3368 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3369 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3370 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3371 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3372 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3373 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3374 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3375 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3376 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3377 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3378 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3379 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3380 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3381 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3382 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3383 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3384 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3385 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3386 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3387 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3388 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3389 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3390 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3391 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3392 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3393 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3394 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3395 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3396 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3397 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3398 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3399 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3400 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3401 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3402 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3403 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3404 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3405 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3406 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3407 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3408 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3409 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3410 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3411 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3412 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3413 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3414 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3415 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3416 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3417 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3418 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3419 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3420 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3421 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3422 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3423 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3424 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3425 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3426 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3427 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3428 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3429 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3430 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3431 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3432 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3433 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3434 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3435 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3436 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3437 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3438 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3439 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3440 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3441 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3442 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3443 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3444 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3445 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3446 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3447 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3448 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3449 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3450 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3451 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3452 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3453 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3454 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3455 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3456 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3457 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3458 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3459 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3460 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3461 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3462 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3463 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3464 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3465 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3466 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3467 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3468 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3469 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3470 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3471 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3472 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3473 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3474 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3475 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3476 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3477 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3478 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3479 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3480 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3481 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3482 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3483 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3484 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3485 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3486 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3487 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3488 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3489 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3490 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3491 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3492 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3493 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3494 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3495 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3496 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3497 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3498 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3499 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3500 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3501 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3502 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3503 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3504 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3505 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3506 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3507 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3508 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3509 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3510 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3511 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3512 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3513 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3514 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3515 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3516 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3517 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3518 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3519 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3520 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3521 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3522 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3523 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3524 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3525 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3526 - protein, 189 aa, Artificial Sequence
  Artificially synthesized modified ADAM10 peptide
NPLNKYIRHYEGLSYNVDSLHQKHQAAKRAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3527 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3528 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3529 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3530 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3531 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3532 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3533 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3534 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3535 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3536 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3537 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3538 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3539 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3540 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3541 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3542 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3543 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3544 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3545 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3546 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3547 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3548 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3549 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3550 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3551 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3552 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3553 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3554 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3555 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3556 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3557 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3558 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3559 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3560 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3561 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3562 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3563 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3564 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3565 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3566 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3567 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3568 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3569 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3570 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3571 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3572 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3573 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3574 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3575 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3576 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3577 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3578 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3579 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3580 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3581 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3582 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3583 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3584 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3585 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3586 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3587 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3588 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3589 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3590 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3591 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3592 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3593 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3594 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3595 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3596 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3597 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3598 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3599 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3600 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3601 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3602 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3603 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3604 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3605 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3606 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3607 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3608 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3609 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3610 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3611 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3612 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3613 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3614 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3615 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3616 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3617 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3618 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3619 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3620 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3621 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3622 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3623 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3624 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3625 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3626 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3627 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3628 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3629 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3630 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3631 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3632 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3633 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3634 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3635 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3636 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3637 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3638 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3639 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3640 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3641 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3642 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3643 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3644 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3645 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3646 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3647 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3648 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3649 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3650 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3651 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3652 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3653 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3654 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3655 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3656 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3657 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3658 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3659 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3660 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3661 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3662 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3663 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3664 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3665 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3666 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3667 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3668 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3669 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3670 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3671 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3672 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3673 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3674 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3675 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3676 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3677 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3678 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3679 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3680 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3681 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3682 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3683 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3684 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3685 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3686 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3687 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3688 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3689 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3690 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3691 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3692 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3693 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3694 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3695 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3696 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3697 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3698 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3699 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3700 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3701 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3702 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3703 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3704 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3705 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3706 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3707 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3708 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3709 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3710 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3711 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3712 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3713 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3714 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3715 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3716 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3717 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3718 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3719 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3720 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3721 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3722 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3723 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3724 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3725 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3726 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3727 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3728 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3729 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3730 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3731 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3732 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3733 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3734 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3735 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3736 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3737 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3738 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3739 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3740 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3741 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3742 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3743 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3744 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3745 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3746 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3747 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3748 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3749 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3750 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3751 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3752 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3753 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3754 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3755 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3756 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3757 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3758 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3759 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3760 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3761 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3762 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3763 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3764 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3765 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3766 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3767 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3768 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3769 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3770 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3771 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3772 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3773 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3774 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3775 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3776 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3777 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3778 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3779 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3780 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3781 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3782 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3783 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3784 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3785 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3786 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3787 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3788 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3789 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3790 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3791 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3792 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3793 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3794 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3795 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3796 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3797 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3798 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3799 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3800 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3801 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3802 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3803 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3804 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3805 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3806 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3807 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3808 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3809 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3810 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3811 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3812 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3813 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3814 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3815 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3816 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3817 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3818 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3819 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3820 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3821 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3822 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3823 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3824 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3825 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3826 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3827 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3828 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3829 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3830 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3831 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3832 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3833 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3834 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3835 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3836 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3837 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3838 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3839 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3840 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3841 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3842 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3843 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3844 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3845 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3846 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3847 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3848 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3849 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3850 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3851 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3852 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3853 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3854 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3855 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3856 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3857 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3858 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3859 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3860 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3861 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3862 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3863 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3864 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3865 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3866 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3867 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3868 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3869 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3870 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3871 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3872 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3873 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3874 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3875 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3876 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3877 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3878 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3879 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3880 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3881 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3882 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3883 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3884 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3885 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3886 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3887 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3888 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3889 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3890 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3891 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3892 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3893 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3894 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3895 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3896 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3897 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3898 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3899 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3900 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3901 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3902 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3903 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3904 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3905 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3906 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3907 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3908 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3909 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3910 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3911 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3912 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3913 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3914 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3915 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3916 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3917 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3918 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3919 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3920 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3921 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3922 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3923 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3924 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3925 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3926 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3927 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3928 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3929 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3930 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3931 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3932 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3933 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3934 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3935 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3936 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3937 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3938 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3939 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3940 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3941 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3942 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3943 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3944 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3945 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3946 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3947 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3948 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3949 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3950 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3951 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3952 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3953 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3954 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3955 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3956 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3957 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3958 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3959 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3960 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3961 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3962 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3963 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3964 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3965 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3966 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3967 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3968 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3969 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3970 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3971 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3972 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3973 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3974 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3975 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3976 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3977 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3978 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3979 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3980 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3981 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3982 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3983 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 3984 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 3985 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 3986 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 3987 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 3988 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 3989 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 3990 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 3991 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 3992 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 3993 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 3994 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 3995 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 3996 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 3997 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 3998 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 3999 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4000 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4001 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4002 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4003 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4004 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4005 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4006 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4007 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4008 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4009 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4010 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4011 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4012 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4013 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4014 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4015 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4016 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4017 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4018 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4019 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4020 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4021 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4022 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4023 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4024 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4025 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4026 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4027 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4028 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4029 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4030 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4031 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4032 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4033 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4034 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4035 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4036 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4037 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4038 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4039 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4040 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4041 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4042 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4043 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4044 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4045 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4046 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4047 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4048 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4049 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4050 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4051 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4052 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4053 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4054 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4055 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4056 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4057 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4058 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4059 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4060 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4061 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4062 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4063 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4064 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4065 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4066 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4067 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4068 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4069 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4070 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4071 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4072 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4073 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4074 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4075 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4076 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4077 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4078 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4079 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4080 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4081 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4082 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4083 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4084 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4085 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4086 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4087 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4088 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4089 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4090 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4091 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4092 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4093 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4094 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4095 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4096 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4097 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4098 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4099 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4100 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4101 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4102 - protein, 189 aa, Artificial Sequence
  Artificially synthesized modified ADAM10 peptide
NPLNKYIRHYEGLSYNVDSLHQKHQAAKKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4103 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4104 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4105 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4106 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4107 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4108 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4109 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4110 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4111 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4112 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4113 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4114 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4115 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4116 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4117 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4118 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4119 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4120 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4121 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4122 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4123 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4124 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4125 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4126 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4127 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4128 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4129 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4130 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4131 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4132 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4133 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4134 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4135 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4136 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4137 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4138 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4139 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4140 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4141 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4142 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4143 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4144 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4145 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4146 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4147 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4148 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4149 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4150 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4151 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4152 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4153 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4154 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4155 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4156 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4157 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4158 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4159 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4160 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4161 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4162 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4163 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4164 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4165 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4166 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4167 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4168 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4169 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4170 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4171 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4172 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4173 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4174 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4175 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4176 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4177 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4178 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4179 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4180 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4181 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4182 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4183 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4184 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4185 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4186 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4187 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4188 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4189 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4190 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4191 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4192 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4193 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4194 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4195 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4196 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4197 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4198 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4199 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4200 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4201 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4202 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4203 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4204 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4205 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4206 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4207 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4208 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4209 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4210 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4211 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4212 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4213 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4214 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4215 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4216 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4217 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4218 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4219 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4220 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4221 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4222 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4223 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4224 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4225 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4226 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4227 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4228 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4229 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4230 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4231 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4232 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4233 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4234 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4235 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4236 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4237 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4238 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4239 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4240 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4241 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4242 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4243 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4244 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4245 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4246 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4247 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4248 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4249 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4250 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4251 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4252 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4253 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4254 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4255 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4256 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4257 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4258 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4259 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4260 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4261 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4262 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4263 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4264 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4265 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4266 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4267 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4268 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4269 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4270 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4271 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4272 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4273 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4274 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4275 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4276 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4277 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4278 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4279 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4280 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4281 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4282 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4283 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4284 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4285 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4286 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4287 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4288 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4289 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4290 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4291 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4292 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4293 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4294 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4295 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4296 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4297 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4298 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4299 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4300 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4301 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4302 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4303 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4304 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4305 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4306 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4307 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4308 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4309 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4310 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4311 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4312 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4313 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4314 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4315 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4316 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4317 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4318 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4319 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4320 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4321 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4322 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4323 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4324 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4325 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4326 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4327 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4328 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4329 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4330 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4331 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4332 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4333 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4334 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4335 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4336 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4337 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4338 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4339 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4340 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4341 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4342 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4343 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4344 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4345 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4346 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4347 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4348 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4349 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4350 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4351 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4352 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4353 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4354 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4355 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4356 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4357 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4358 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4359 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4360 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4361 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4362 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4363 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4364 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4365 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4366 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4367 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4368 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4369 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4370 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4371 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4372 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4373 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4374 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4375 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4376 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4377 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4378 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4379 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4380 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4381 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4382 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4383 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4384 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4385 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4386 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4387 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4388 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4389 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4390 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4391 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4392 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4393 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4394 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4395 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4396 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4397 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4398 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4399 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4400 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4401 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4402 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4403 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4404 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4405 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4406 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4407 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4408 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4409 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4410 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4411 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4412 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4413 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4414 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4415 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4416 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4417 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4418 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4419 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4420 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4421 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4422 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4423 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4424 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4425 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4426 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4427 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4428 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4429 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4430 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4431 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4432 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4433 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4434 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4435 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4436 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4437 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4438 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4439 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4440 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4441 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4442 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4443 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4444 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4445 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4446 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4447 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4448 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4449 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4450 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4451 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4452 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4453 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4454 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4455 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4456 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4457 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4458 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4459 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4460 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4461 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4462 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4463 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4464 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4465 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4466 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4467 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4468 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4469 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4470 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4471 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4472 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4473 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4474 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4475 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4476 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4477 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4478 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4479 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4480 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4481 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4482 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4483 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4484 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4485 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4486 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4487 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4488 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4489 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4490 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4491 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4492 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4493 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4494 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4495 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4496 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4497 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4498 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4499 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4500 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4501 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4502 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4503 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4504 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4505 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4506 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4507 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4508 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4509 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4510 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4511 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4512 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4513 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4514 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4515 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4516 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4517 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4518 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4519 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4520 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4521 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4522 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4523 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4524 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4525 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4526 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4527 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4528 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4529 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4530 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4531 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4532 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4533 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4534 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4535 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4536 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4537 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4538 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4539 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4540 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4541 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4542 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4543 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4544 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4545 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4546 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4547 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4548 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4549 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4550 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4551 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4552 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4553 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4554 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4555 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4556 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4557 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4558 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4559 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4560 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4561 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4562 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4563 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4564 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4565 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4566 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4567 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4568 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4569 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4570 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4571 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4572 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4573 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4574 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4575 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4576 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4577 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4578 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4579 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4580 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4581 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4582 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4583 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4584 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4585 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4586 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4587 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4588 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4589 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4590 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4591 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4592 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4593 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4594 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4595 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4596 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4597 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4598 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4599 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4600 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4601 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4602 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4603 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4604 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4605 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4606 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4607 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4608 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4609 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4610 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4611 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4612 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4613 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4614 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4615 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4616 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4617 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4618 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4619 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4620 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4621 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4622 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4623 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4624 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4625 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4626 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4627 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4628 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4629 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4630 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4631 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4632 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4633 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4634 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4635 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4636 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4637 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4638 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4639 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4640 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4641 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4642 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4643 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4644 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4645 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4646 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4647 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4648 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4649 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4650 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4651 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4652 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4653 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4654 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4655 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4656 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4657 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4658 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4659 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4660 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4661 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4662 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4663 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4664 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4665 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4666 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4667 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4668 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4669 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4670 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4671 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4672 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4673 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4674 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4675 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4676 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4677 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4678 - protein, 189 aa, Artificial Sequence
  Artificially synthesized modified ADAM10 peptide
NPLNKYIRHYEGLSYNVDSLHQKHQAAARAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4679 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4680 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4681 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4682 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4683 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4684 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4685 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4686 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4687 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4688 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4689 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4690 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4691 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4692 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4693 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4694 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4695 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4696 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4697 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4698 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4699 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4700 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4701 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4702 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4703 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4704 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4705 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4706 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4707 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4708 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4709 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4710 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4711 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4712 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4713 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4714 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4715 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4716 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4717 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4718 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4719 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4720 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4721 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4722 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4723 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4724 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4725 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4726 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4727 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4728 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4729 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4730 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4731 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4732 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4733 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4734 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4735 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4736 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4737 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4738 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4739 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4740 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4741 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4742 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4743 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4744 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4745 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4746 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4747 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4748 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4749 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4750 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4751 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4752 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4753 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4754 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4755 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4756 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4757 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4758 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4759 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4760 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4761 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4762 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4763 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4764 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4765 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4766 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4767 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4768 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4769 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4770 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4771 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4772 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4773 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4774 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4775 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4776 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4777 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4778 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4779 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4780 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4781 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4782 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4783 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4784 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4785 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4786 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4787 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4788 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4789 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4790 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4791 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4792 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4793 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4794 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4795 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4796 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4797 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4798 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4799 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4800 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4801 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4802 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4803 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4804 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4805 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4806 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4807 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4808 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4809 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4810 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4811 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4812 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4813 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4814 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4815 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4816 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4817 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4818 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4819 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4820 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4821 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4822 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4823 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4824 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4825 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4826 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4827 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4828 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4829 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4830 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4831 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4832 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4833 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4834 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4835 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4836 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4837 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4838 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4839 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4840 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4841 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4842 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4843 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4844 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4845 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4846 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4847 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4848 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4849 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4850 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4851 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4852 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4853 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4854 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4855 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4856 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4857 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4858 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4859 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4860 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4861 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4862 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4863 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4864 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4865 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4866 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4867 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4868 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4869 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4870 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4871 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4872 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4873 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4874 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4875 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4876 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4877 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4878 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4879 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4880 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4881 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4882 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4883 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4884 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4885 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4886 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4887 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4888 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4889 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4890 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4891 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4892 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4893 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4894 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4895 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4896 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4897 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4898 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4899 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4900 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4901 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4902 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4903 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4904 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4905 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4906 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4907 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4908 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4909 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4910 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4911 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4912 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4913 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4914 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4915 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4916 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4917 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4918 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4919 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4920 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4921 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4922 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4923 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4924 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4925 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4926 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4927 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4928 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4929 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4930 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4931 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4932 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4933 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4934 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4935 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4936 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4937 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4938 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4939 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4940 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4941 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4942 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4943 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4944 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4945 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4946 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4947 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4948 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4949 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4950 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4951 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4952 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4953 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4954 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4955 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4956 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4957 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4958 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4959 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4960 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4961 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4962 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4963 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4964 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4965 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4966 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4967 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4968 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4969 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4970 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4971 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4972 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4973 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4974 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4975 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4976 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4977 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4978 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4979 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4980 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4981 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4982 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4983 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 4984 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 4985 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 4986 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 4987 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 4988 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 4989 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 4990 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 4991 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 4992 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 4993 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 4994 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 4995 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 4996 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 4997 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 4998 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLRMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 4999 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5000 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5001 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5002 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5003 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5004 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5005 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5006 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5007 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5008 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5009 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5010 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5011 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5012 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5013 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5014 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5015 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5016 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5017 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5018 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5019 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5020 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5021 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5022 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5023 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5024 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5025 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5026 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5027 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5028 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5029 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5030 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5031 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5032 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5033 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5034 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5035 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5036 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5037 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5038 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5039 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5040 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5041 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5042 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5043 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5044 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5045 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5046 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5047 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5048 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5049 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5050 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5051 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5052 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5053 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5054 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5055 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5056 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5057 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5058 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5059 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5060 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5061 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5062 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5063 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5064 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5065 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5066 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5067 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5068 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5069 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5070 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5071 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5072 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5073 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5074 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5075 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5076 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5077 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5078 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5079 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5080 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5081 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5082 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5083 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5084 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5085 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5086 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5087 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5088 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5089 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5090 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5091 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5092 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5093 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5094 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5095 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5096 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5097 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5098 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5099 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5100 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5101 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5102 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5103 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5104 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5105 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5106 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5107 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5108 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5109 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5110 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5111 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5112 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5113 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5114 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5115 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5116 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5117 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5118 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5119 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5120 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5121 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5122 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5123 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5124 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5125 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5126 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5127 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5128 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5129 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5130 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5131 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5132 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5133 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5134 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5135 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5136 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5137 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5138 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5139 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5140 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5141 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5142 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5143 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5144 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5145 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5146 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5147 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5148 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5149 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5150 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5151 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5152 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5153 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5154 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5155 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5156 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5157 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5158 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5159 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5160 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5161 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5162 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5163 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5164 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5165 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5166 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5167 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5168 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5169 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5170 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5171 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5172 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5173 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5174 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5175 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5176 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5177 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5178 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5179 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5180 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5181 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5182 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5183 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5184 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5185 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5186 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5187 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5188 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5189 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5190 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMARDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5191 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5192 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5193 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5194 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5195 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5196 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5197 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5198 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5199 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5200 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5201 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5202 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5203 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5204 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5205 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5206 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5207 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5208 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5209 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5210 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5211 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5212 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5213 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5214 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5215 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5216 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5217 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5218 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5219 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5220 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5221 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5222 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5223 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5224 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5225 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5226 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5227 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5228 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5229 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5230 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5231 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5232 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5233 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5234 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5235 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5236 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5237 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5238 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5239 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5240 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5241 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5242 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5243 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5244 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5245 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5246 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5247 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5248 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5249 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5250 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5251 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5252 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5253 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5254 - protein, 189 aa, Artificial Sequence
  Artificially synthesized modified ADAM10 peptide
NPLNKYIRHYEGLSYNVDSLHQKHQAAAKAVSHEDQFLRLDFHAHGRHFNLAMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5255 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5256 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5257 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5258 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5259 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5260 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5261 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5262 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5263 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5264 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5265 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5266 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5267 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5268 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5269 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5270 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5271 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5272 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5273 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5274 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5275 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5276 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5277 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5278 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5279 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5280 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5281 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5282 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5283 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5284 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5285 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5286 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5287 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5288 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5289 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5290 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5291 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5292 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5293 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5294 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5295 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5296 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5297 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5298 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5299 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5300 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5301 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5302 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5303 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5304 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5305 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5306 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5307 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5308 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5309 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5310 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5311 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5312 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5313 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5314 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5315 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5316 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5317 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5318 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5319 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5320 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5321 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5322 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5323 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5324 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5325 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5326 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5327 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5328 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5329 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5330 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5331 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5332 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5333 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5334 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5335 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5336 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5337 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5338 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5339 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5340 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5341 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5342 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5343 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5344 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5345 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5346 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5347 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5348 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5349 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5350 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5351 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5352 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5353 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5354 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5355 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5356 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5357 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5358 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5359 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5360 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5361 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5362 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5363 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5364 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5365 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5366 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5367 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5368 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5369 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5370 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5371 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5372 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5373 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5374 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5375 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5376 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5377 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5378 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5379 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5380 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5381 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5382 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5383 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5384 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5385 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5386 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5387 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5388 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5389 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5390 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5391 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5392 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5393 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5394 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5395 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5396 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5397 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5398 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5399 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5400 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5401 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5402 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5403 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5404 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5405 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5406 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5407 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5408 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5409 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5410 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5411 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5412 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5413 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5414 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5415 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5416 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5417 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5418 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5419 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5420 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5421 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5422 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5423 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5424 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5425 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5426 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5427 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5428 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5429 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5430 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5431 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5432 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5433 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5434 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5435 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5436 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5437 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5438 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5439 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5440 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5441 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5442 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5443 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5444 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5445 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5446 - protein, 189 aa, Artificial Sequence
  Artificially synthesized modified ADAM10 peptide
NPLNKYIRHYEGLSYNVDSLHQKHQKAKKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5447 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5448 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5449 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5450 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5451 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5452 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5453 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5454 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5455 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5456 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5457 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5458 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5459 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5460 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5461 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5462 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5463 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5464 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5465 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5466 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5467 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5468 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5469 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5470 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5471 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5472 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5473 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5474 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5475 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5476 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5477 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5478 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5479 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5480 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5481 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5482 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5483 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5484 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5485 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5486 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5487 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5488 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5489 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5490 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5491 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5492 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5493 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5494 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5495 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5496 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5497 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5498 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5499 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5500 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5501 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5502 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5503 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5504 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5505 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5506 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5507 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5508 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5509 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5510 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5511 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5512 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5513 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5514 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5515 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5516 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5517 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5518 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5519 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5520 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5521 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5522 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5523 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5524 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5525 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5526 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5527 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5528 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5529 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5530 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5531 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5532 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5533 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5534 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5535 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5536 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5537 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5538 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5539 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5540 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5541 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5542 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5543 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5544 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5545 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5546 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5547 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5548 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5549 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5550 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5551 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5552 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5553 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5554 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5555 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5556 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5557 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5558 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5559 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5560 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5561 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5562 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5563 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5564 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5565 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5566 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5567 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5568 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5569 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5570 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5571 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5572 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5573 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5574 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5575 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5576 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5577 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5578 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5579 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5580 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5581 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5582 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5583 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5584 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5585 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5586 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5587 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5588 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5589 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5590 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5591 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5592 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5593 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5594 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5595 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5596 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5597 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5598 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5599 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5600 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5601 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5602 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5603 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5604 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5605 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5606 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5607 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5608 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5609 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5610 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5611 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5612 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5613 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5614 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5615 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5616 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5617 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5618 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5619 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5620 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5621 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5622 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5623 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5624 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5625 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5626 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5627 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5628 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5629 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5630 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5631 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5632 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5633 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5634 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5635 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5636 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5637 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5638 - protein, 189 aa, Artificial Sequence
  Artificially synthesized modified ADAM10 peptide
NPLNKYIRHYEGLSYNVDSLHQKHQKAAKAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5639 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5640 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5641 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5642 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5643 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5644 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5645 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5646 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5647 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5648 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5649 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5650 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5651 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5652 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5653 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5654 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5655 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5656 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5657 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5658 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5659 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5660 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5661 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5662 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5663 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5664 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5665 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5666 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5667 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5668 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5669 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5670 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5671 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5672 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5673 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5674 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5675 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5676 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5677 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5678 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5679 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5680 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5681 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5682 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5683 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5684 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5685 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5686 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5687 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5688 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5689 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5690 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5691 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5692 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5693 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5694 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5695 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5696 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5697 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5698 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5699 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5700 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5701 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5702 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5703 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5704 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5705 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5706 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5707 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5708 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5709 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5710 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5711 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5712 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5713 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5714 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5715 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5716 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5717 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5718 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5719 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5720 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5721 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5722 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5723 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5724 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5725 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5726 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5727 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5728 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5729 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5730 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5731 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5732 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5733 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5734 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5735 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5736 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5737 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5738 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5739 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5740 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5741 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5742 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5743 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5744 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5745 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5746 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5747 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5748 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5749 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5750 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5751 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5752 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5753 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5754 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5755 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5756 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5757 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5758 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5759 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5760 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5761 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5762 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5763 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5764 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5765 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5766 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMAKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5767 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5768 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5769 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5770 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5771 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5772 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5773 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5774 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5775 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5776 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5777 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5778 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5779 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5780 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5781 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5782 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5783 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5784 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5785 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5786 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5787 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5788 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5789 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5790 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5791 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5792 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5793 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5794 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5795 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5796 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5797 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5798 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5799 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5800 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5801 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5802 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5803 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5804 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5805 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5806 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5807 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5808 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5809 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5810 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5811 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5812 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5813 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5814 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5815 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5816 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5817 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5818 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5819 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5820 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5821 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5822 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5823 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5824 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5825 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5826 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5827 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5828 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5829 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5830 - protein, 189 aa, Artificial Sequence
  Artificially synthesized modified ADAM10 peptide
NPLNKYIRHYEGLSYNVDSLHQKHQKAKRAVSHEDQFLRLDFHAHGRHFNLKMKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5831 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5832 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5833 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5834 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5835 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5836 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5837 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5838 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5839 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5840 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5841 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5842 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5843 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5844 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5845 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5846 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5847 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5848 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5849 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5850 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5851 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5852 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5853 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5854 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5855 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5856 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5857 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5858 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5859 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5860 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5861 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5862 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5863 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5864 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5865 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5866 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5867 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5868 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5869 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5870 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5871 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5872 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5873 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5874 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5875 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5876 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5877 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5878 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5879 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5880 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5881 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5882 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5883 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5884 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5885 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5886 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5887 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5888 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5889 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5890 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5891 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5892 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5893 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5894 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5895 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5896 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5897 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5898 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5899 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5900 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5901 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5902 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5903 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5904 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5905 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5906 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5907 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5908 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5909 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5910 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5911 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5912 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5913 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5914 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5915 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5916 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5917 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5918 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5919 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5920 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5921 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5922 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5923 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5924 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5925 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5926 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5927 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5928 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5929 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5930 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5931 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5932 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5933 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5934 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5935 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5936 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5937 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5938 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5939 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5940 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5941 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5942 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5943 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5944 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5945 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5946 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5947 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5948 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5949 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5950 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5951 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5952 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5953 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5954 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5955 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5956 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5957 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5958 - protein, 189 aa, Artificial Sequence
  Artificially synthesized modified ADAM10 peptide
NPLNKYIRHYEGLSYNVDSLHQKHQARKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5959 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5960 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5961 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5962 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5963 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5964 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5965 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5966 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5967 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5968 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5969 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5970 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5971 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5972 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5973 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5974 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5975 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5976 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5977 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5978 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5979 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5980 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5981 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5982 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5983 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 5984 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 5985 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 5986 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 5987 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 5988 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 5989 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 5990 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 5991 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 5992 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 5993 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 5994 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 5995 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 5996 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 5997 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 5998 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 5999 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6000 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6001 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6002 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6003 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6004 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6005 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6006 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6007 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6008 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6009 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6010 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6011 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6012 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6013 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6014 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6015 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6016 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6017 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6018 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6019 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6020 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6021 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6022 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMRKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6023 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6024 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6025 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6026 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6027 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6028 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6029 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6030 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6031 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6032 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6033 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6034 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6035 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6036 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6037 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6038 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6039 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6040 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6041 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6042 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6043 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6044 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6045 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6046 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6047 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6048 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6049 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6050 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6051 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6052 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6053 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6054 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6055 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6056 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6057 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6058 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6059 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6060 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6061 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6062 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6063 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6064 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6065 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6066 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6067 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6068 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6069 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6070 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6071 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6072 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6073 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6074 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6075 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6076 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6077 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6078 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6079 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6080 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6081 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6082 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6083 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6084 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6085 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6086 - protein, 189 aa, Artificial Sequence
  Artificially synthesized modified ADAM10 peptide
NPLNKYIRHYEGLSYNVDSLHQKHQAKKRAVSHEDQFLRLDFHAHGRHFNLMKKRDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6087 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6088 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6089 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6090 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6091 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6092 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6093 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6094 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6095 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6096 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6097 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6098 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6099 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6100 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6101 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6102 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6103 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6104 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6105 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6106 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6107 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6108 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6109 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6110 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6111 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6112 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6113 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6114 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6115 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6116 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6117 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6118 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6119 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6120 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6121 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6122 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6123 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6124 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6125 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6126 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6127 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6128 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6129 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6130 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6131 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6132 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6133 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6134 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6135 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6136 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6137 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6138 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6139 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6140 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6141 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6142 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6143 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6144 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6145 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6146 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6147 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6148 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6149 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6150 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6151 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6152 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6153 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6154 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6155 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6156 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6157 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6158 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6159 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6160 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6161 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6162 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6163 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6164 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6165 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6166 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6167 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6168 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6169 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6170 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6171 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6172 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6173 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6174 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6175 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6176 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6177 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6178 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6179 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6180 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6181 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6182 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6183 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6184 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6185 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6186 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6187 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6188 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6189 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6190 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6191 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6192 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6193 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6194 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6195 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6196 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6197 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6198 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6199 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6200 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6201 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6202 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6203 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6204 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6205 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6206 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6207 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6208 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6209 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6210 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6211 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6212 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6213 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6214 - protein, 189 aa, Artificial Sequence
  Artificially synthesized modified ADAM10 peptide
NPLNKYIRHYEGLSYNVDSLHQKHQRARKAVSHEDQFLRLDFHAHGRHFNLRMKKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6215 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6216 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6217 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6218 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6219 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6220 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6221 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6222 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6223 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6224 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6225 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6226 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6227 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6228 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6229 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6230 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6231 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6232 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6233 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6234 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6235 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6236 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6237 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6238 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6239 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6240 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6241 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6242 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6243 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6244 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6245 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6246 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6247 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6248 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6249 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6250 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6251 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6252 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6253 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6254 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6255 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6256 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6257 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6258 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6259 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6260 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6261 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6262 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6263 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRK

SEQ ID NO: 6264 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQEAHAANGPELLRK

SEQ ID NO: 6265 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAEHAANGPELLRK

SEQ ID NO: 6266 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPQAAHAANGPELLRK

SEQ ID NO: 6267 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEEHAANGPELLRK

SEQ ID NO: 6268 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAEAHAANGPELLRK

SEQ ID NO: 6269 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAEHAANGPELLRK

SEQ ID NO: 6270 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEEVTQIPAAAHAANGPELLRK

SEQ ID NO: 6271 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEEHAANGPELLRK

SEQ ID NO: 6272 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQEAHAANGPELLRK

SEQ ID NO: 6273 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAEHAANGPELLRK

SEQ ID NO: 6274 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPQAAHAANGPELLRK

SEQ ID NO: 6275 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEEHAANGPELLRK

SEQ ID NO: 6276 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAEAHAANGPELLRK

SEQ ID NO: 6277 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAEHAANGPELLRK

SEQ ID NO: 6278 - protein, 189 aa, Artificial Sequence
  Artificially synthesized modified ADAM10 peptide
NPLNKYIRHYEGLSYNVDSLHQKHQRAKKAVSHEDQFLRLDFHAHGRHFNLRMRKDTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEEVTQIPAAAHAANGPELLRK

SEQ ID NO: 6279 - protein, 189 aa, Artificial Sequence; identical to SEQ ID NO: 711
  Artificially synthesized modified ADAM10 peptide

SEQ ID NO: 6280 - protein, 189 aa, Artificial Sequence; identical to SEQ ID NO: 712
  Artificially synthesized modified ADAM10 peptide

SEQ ID NO: 6281 - protein, 189 aa, Artificial Sequence; identical to SEQ ID NO: 713
  Artificially synthesized modified ADAM10 peptide

SEQ ID NO: 6282 - protein, 189 aa, Artificial Sequence; identical to SEQ ID NO: 714
  Artificially synthesized modified ADAM10 peptide

SEQ ID NO: 6283 - protein, 189 aa, Artificial Sequence; identical to SEQ ID NO: 715
  Artificially synthesized modified ADAM10 peptide

SEQ ID NO: 6284 - protein, 189 aa, Artificial Sequence; identical to SEQ ID NO: 716
  Artificially synthesized modified ADAM10 peptide

SEQ ID NO: 6285 - protein, 189 aa, Artificial Sequence; identical to SEQ ID NO: 717
  Artificially synthesized modified ADAM10 peptide

SEQ ID NO: 6286 - protein, 189 aa, Artificial Sequence; identical to SEQ ID NO: 718
  Artificially synthesized modified ADAM10 peptide

SEQ ID NO: 6287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 6288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 6289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 6290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 6291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 6292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 6293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 6294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 6295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 6296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 6297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 6298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 6299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 6300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 6301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 6302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 6303 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 6304 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 6305 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 6306 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 6307 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 6308 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 6309 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 6310 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 6311 - protein, 189 aa, Artificial Sequence; identical to SEQ ID NO: 719
  Artificially synthesized modified ADAM10 peptide

SEQ ID NO: 6312 - protein, 189 aa, Artificial Sequence; identical to SEQ ID NO: 720
  Artificially synthesized modified ADAM10 peptide

SEQ ID NO: 6313 - protein, 189 aa, Artificial Sequence; identical to SEQ ID NO: 62
  Artificially synthesized modified ADAM10 peptide

SEQ ID NO: 6314 - protein, 189 aa, Artificial Sequence; identical to SEQ ID NO: 722
  Artificially synthesized modified ADAM10 peptide

SEQ ID NO: 6315 - protein, 189 aa, Artificial Sequence; identical to SEQ ID NO: 723
  Artificially synthesized modified ADAM10 peptide

SEQ ID NO: 6316 - protein, 189 aa, Artificial Sequence; identical to SEQ ID NO: 724
  Artificially synthesized modified ADAM10 peptide

SEQ ID NO: 6317 - protein, 189 aa, Artificial Sequence; identical to SEQ ID NO: 725
  Artificially synthesized modified ADAM10 peptide

SEQ ID NO: 6318 - protein, 189 aa, Artificial Sequence; identical to SEQ ID NO: 726
  Artificially synthesized modified ADAM10 peptide

SEQ ID NO: 6319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 6320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 6321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 6322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 6323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 6324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 6325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 6326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 6327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 6328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 6329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 6330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 6331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 6332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 6333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 6334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 6335 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 6336 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 6337 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 6338 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 6339 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 6340 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 6341 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 6342 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 6343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 6344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 6345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 6346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 6347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 6348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 6349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 6350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 6351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 6352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 6353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 6354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 6355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 6356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 6357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 6358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 6359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 6360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 6361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 6362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 6363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 6364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 6365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 6366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 6367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 6368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 6369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 6370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 6371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 6372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 6373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 6374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 6375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 6376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 6377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 6378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 6379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 6380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 6381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 6382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 6383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 6384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 6385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 6386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 6387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 6388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 6389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 6390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 6391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 6392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 6393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 6394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 6395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 6396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 6397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 6398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 6399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 6400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 6401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 6402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 6403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 6404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 6405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 6406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 6407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 6408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 6409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 6410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 6411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 6412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 6413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 6414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 6415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 6416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 6417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 6418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 6419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 6420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 6421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 6422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 6423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 6424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 6425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 6426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 6427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 6428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 6429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 6430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 6431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 6432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 6433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 6434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 6435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 6436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 6437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 6438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 6439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 6440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 6441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 6442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 6443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 6444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 6445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 6446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 6447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 6448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 6449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 6450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 6451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 6452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 6453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 6454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 6455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 6456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 6457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 6458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 6459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 6460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 6461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 6462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 6463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 6464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 6465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 6466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 6467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 6468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 6469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 6470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 6471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 6472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 6473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 6474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 6475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 6476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 6477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 6478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 6479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 6480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 6481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 6482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 6483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 6484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 6485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 6486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 6487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 6488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 6489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 6490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 6491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 6492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 6493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 6494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 6495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 6496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 6497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 6498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 6499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 6500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 6501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 6502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 6503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 6504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 6505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 6506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 6507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 6508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 6509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 6510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 6511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 6512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 6513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 6514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 6515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 6516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 6517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 6518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 6519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 6520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 6521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 6522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 6523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 6524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 6525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 6526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 6527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 6528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 6529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 6530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 6531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 6532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 6533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 6534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 6535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 6536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 6537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 6538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 6539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 6540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 6541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 6542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 6543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 6544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 6545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 6546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 6547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 6548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 6549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 6550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 6551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 6552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 6553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 6554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 6555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 6556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 6557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 6558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 6559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 6560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 6561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 6562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 6563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 6564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 6565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 6566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 6567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 6568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 6569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 6570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 6571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 6572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 6573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 6574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 6575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 6576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 6577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 6578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 6579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 6580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 6581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 6582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 6583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 6584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 6585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 6586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 6587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 6588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 6589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 6590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 6591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 6592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 6593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 6594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 6595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 6596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 6597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 6598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 6599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 6600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 6601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 6602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 6603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 6604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 6605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 6606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 6607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 6608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 6609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 6610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 6611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 6612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 6613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 6614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 6615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 6616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 6617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 6618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 6619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 6620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 6621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 6622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 6623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 6624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 6625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 6626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 6627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 6628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 6629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 6630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 6631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 6632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 6633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 6634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 6635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 6636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 6637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 6638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 6639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 6640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 6641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 6642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 6643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 6644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 6645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 6646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 6647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 6648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 6649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 6650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 6651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 6652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 6653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 6654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 6655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 6656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 6657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 6658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 6659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 6660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 6661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 6662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 6663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 6664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 6665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 6666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 6667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 6668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 6669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 6670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 6671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 6672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 6673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 6674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 6675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 6676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 6677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 6678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 6679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 6680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 6681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 6682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 6683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 6684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 6685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 6686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 6687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 6688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 6689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 6690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 6691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 6692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 6693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 6694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 6695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 6696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 6697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 6698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 6699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 6700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 6701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 6702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 6703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 6704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 6705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 6706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 6707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 6708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 6709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 6710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 6711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 6712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 6713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 6714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 6715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 6716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 6717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 6718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 6719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 6720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 6721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 6722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 6723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 6724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 6725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 6726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 6727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 6728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 6729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 6730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 6731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 6732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 6733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 6734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 6735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 6736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 6737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 6738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 6739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 6740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 6741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 6742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 6743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 6744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 6745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 6746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 6747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 6748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 6749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 6750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 6751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 6752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 6753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 6754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 6755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 6756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 6757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 6758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 6759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 6760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 6761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 6762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 6763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 6764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 6765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 6766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 6767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 6768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 6769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 6770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 6771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 6772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 6773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 6774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 6775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 6776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 6777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 6778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 6779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 6780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 6781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 6782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 6783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 6784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 6785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 6786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 6787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 6788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 6789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 6790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 6791 - protein, 189 aa, Artificial Sequence; identical to SEQ ID NO: 727
  Artificially synthesized modified ADAM10 peptide

SEQ ID NO: 6792 - protein, 189 aa, Artificial Sequence; identical to SEQ ID NO: 728
  Artificially synthesized modified ADAM10 peptide

SEQ ID NO: 6793 - protein, 189 aa, Artificial Sequence; identical to SEQ ID NO: 729
  Artificially synthesized modified ADAM10 peptide

SEQ ID NO: 6794 - protein, 189 aa, Artificial Sequence; identical to SEQ ID NO: 730
  Artificially synthesized modified ADAM10 peptide

SEQ ID NO: 6795 - protein, 189 aa, Artificial Sequence; identical to SEQ ID NO: 731
  Artificially synthesized modified ADAM10 peptide

SEQ ID NO: 6796 - protein, 189 aa, Artificial Sequence; identical to SEQ ID NO: 732
  Artificially synthesized modified ADAM10 peptide

SEQ ID NO: 6797 - protein, 189 aa, Artificial Sequence; identical to SEQ ID NO: 733
  Artificially synthesized modified ADAM10 peptide

SEQ ID NO: 6798 - protein, 189 aa, Artificial Sequence; identical to SEQ ID NO: 734
  Artificially synthesized modified ADAM10 peptide

SEQ ID NO: 6799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 6800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 6801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 6802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 6803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 6804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 6805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 6806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 6807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 6808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 6809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 6810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 6811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 6812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 6813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 6814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 6815 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 6816 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 6817 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 6818 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 6819 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 6820 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 6821 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 6822 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 6823 - protein, 189 aa, Artificial Sequence; identical to SEQ ID NO: 735
  Artificially synthesized modified ADAM10 peptide

SEQ ID NO: 6824 - protein, 189 aa, Artificial Sequence; identical to SEQ ID NO: 736
  Artificially synthesized modified ADAM10 peptide

SEQ ID NO: 6825 - protein, 189 aa, Artificial Sequence; identical to SEQ ID NO: 737
  Artificially synthesized modified ADAM10 peptide

SEQ ID NO: 6826 - protein, 189 aa, Artificial Sequence; identical to SEQ ID NO: 738
  Artificially synthesized modified ADAM10 peptide

SEQ ID NO: 6827 - protein, 189 aa, Artificial Sequence; identical to SEQ ID NO: 739
  Artificially synthesized modified ADAM10 peptide

SEQ ID NO: 6828 - protein, 189 aa, Artificial Sequence; identical to SEQ ID NO: 740
  Artificially synthesized modified ADAM10 peptide

SEQ ID NO: 6829 - protein, 189 aa, Artificial Sequence; identical to SEQ ID NO: 741
  Artificially synthesized modified ADAM10 peptide

SEQ ID NO: 6830 - protein, 189 aa, Artificial Sequence; identical to SEQ ID NO: 742
  Artificially synthesized modified ADAM10 peptide

SEQ ID NO: 6831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 6832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 6833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 6834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 6835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 6836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 6837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 6838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 6839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 6840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 6841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 6842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 6843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 6844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 6845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 6846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 6847 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 6848 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 6849 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 6850 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 6851 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 6852 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 6853 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 6854 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 6855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 6856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 6857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 6858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 6859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 6860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 6861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 6862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 6863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 6864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 6865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 6866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 6867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 6868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 6869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 6870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 6871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 6872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 6873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 6874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 6875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 6876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 6877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 6878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 6879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 6880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 6881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 6882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 6883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 6884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 6885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 6886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 6887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 6888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 6889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 6890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 6891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 6892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 6893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 6894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 6895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 6896 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 6897 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 6898 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 6899 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 6900 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 6901 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 6902 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 6903 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 6904 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 6905 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 6906 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 6907 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 6908 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 6909 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 6910 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 6911 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 6912 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 6913 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 6914 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 6915 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 6916 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 6917 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 6918 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 6919 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 6920 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 6921 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 6922 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 6923 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 6924 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 6925 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 6926 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 6927 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 6928 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 6929 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 6930 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 6931 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 6932 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 6933 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 6934 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 6935 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 6936 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 6937 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 6938 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 6939 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 6940 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 6941 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 6942 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 6943 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 6944 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 6945 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 6946 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 6947 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 6948 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 6949 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 6950 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 6951 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 6952 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 6953 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 6954 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 6955 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 6956 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 6957 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 6958 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 6959 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 6960 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 6961 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 6962 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 6963 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 6964 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 6965 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 6966 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 6967 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 6968 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 6969 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 6970 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 6971 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 6972 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 6973 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 6974 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 6975 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 6976 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 6977 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 6978 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 6979 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 6980 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 6981 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 6982 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 6983 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 6984 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 6985 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 6986 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 6987 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 6988 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 6989 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 6990 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 6991 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 6992 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 6993 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 6994 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 6995 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 6996 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 6997 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 6998 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 6999 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 7000 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 7001 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 7002 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 7003 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 7004 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 7005 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 7006 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 7007 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 7008 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 7009 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 7010 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 7011 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 7012 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 7013 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 7014 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 7015 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 7016 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 7017 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 7018 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 7019 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 7020 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 7021 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 7022 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 7023 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 7024 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 7025 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 7026 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 7027 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 7028 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 7029 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 7030 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 7031 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 7032 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 7033 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 7034 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 7035 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 7036 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 7037 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 7038 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 7039 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 7040 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 7041 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 7042 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 7043 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 7044 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 7045 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 7046 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 7047 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 7048 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 7049 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 7050 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 7051 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 7052 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 7053 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 7054 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 7055 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 7056 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 7057 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 7058 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 7059 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 7060 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 7061 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 7062 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 7063 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 7064 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 7065 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 7066 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 7067 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 7068 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 7069 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 7070 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 7071 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 7072 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 7073 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 7074 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 7075 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 7076 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 7077 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 7078 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 7079 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 7080 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 7081 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 7082 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 7083 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 7084 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 7085 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 7086 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 7087 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 7088 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 7089 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 7090 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 7091 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 7092 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 7093 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 7094 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 7095 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 7096 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 7097 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 7098 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 7099 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 7100 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 7101 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 7102 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 7103 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 7104 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 7105 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 7106 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 7107 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 7108 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 7109 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 7110 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 7111 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 7112 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 7113 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 7114 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 7115 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 7116 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 7117 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 7118 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 7119 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 7120 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 7121 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 7122 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 7123 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 7124 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 7125 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 7126 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 7127 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 7128 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 7129 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 7130 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 7131 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 7132 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 7133 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 7134 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 7135 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 7136 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 7137 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 7138 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 7139 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 7140 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 7141 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 7142 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 7143 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 7144 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 7145 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 7146 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 7147 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 7148 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 7149 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 7150 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 7151 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 7152 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 7153 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 7154 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 7155 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 7156 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 7157 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 7158 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 7159 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 7160 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 7161 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 7162 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 7163 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 7164 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 7165 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 7166 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 7167 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 7168 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 7169 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 7170 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 7171 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 7172 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 7173 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 7174 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 7175 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 7176 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 7177 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 7178 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 7179 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 7180 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 7181 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 7182 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 7183 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 7184 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 7185 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 7186 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 7187 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 7188 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 7189 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 7190 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 7191 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 7192 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 7193 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 7194 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 7195 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 7196 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 7197 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 7198 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 7199 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 7200 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 7201 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 7202 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 7203 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 7204 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 7205 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 7206 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 7207 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 7208 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 7209 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 7210 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 7211 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 7212 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 7213 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 7214 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 7215 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 7216 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 7217 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 7218 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 7219 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 7220 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 7221 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 7222 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 7223 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 7224 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 7225 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 7226 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 7227 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 7228 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 7229 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 7230 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 7231 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 7232 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 7233 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 7234 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 7235 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 7236 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 7237 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 7238 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 7239 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 7240 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 7241 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 7242 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 7243 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 7244 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 7245 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 7246 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 7247 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 7248 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 7249 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 7250 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 7251 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 7252 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 7253 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 7254 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 7255 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 7256 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 7257 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 7258 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 7259 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 7260 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 7261 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 7262 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 7263 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 7264 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 7265 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 7266 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 7267 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 7268 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 7269 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 7270 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 7271 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 7272 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 7273 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 7274 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 7275 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 7276 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 7277 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 7278 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 7279 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 7280 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 7281 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 7282 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 7283 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 7284 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 7285 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 7286 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 7287 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 7288 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 7289 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 7290 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 7291 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 7292 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 7293 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 7294 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 7295 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 7296 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 7297 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 7298 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 7299 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 7300 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 7301 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 7302 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGEAGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 7303 - protein, 189 aa, Artificial Sequence; identical to SEQ ID NO: 743
  Artificially synthesized modified ADAM10 peptide

SEQ ID NO: 7304 - protein, 189 aa, Artificial Sequence; identical to SEQ ID NO: 744
  Artificially synthesized modified ADAM10 peptide

SEQ ID NO: 7305 - protein, 189 aa, Artificial Sequence; identical to SEQ ID NO: 745
  Artificially synthesized modified ADAM10 peptide

SEQ ID NO: 7306 - protein, 189 aa, Artificial Sequence; identical to SEQ ID NO: 746
  Artificially synthesized modified ADAM10 peptide

SEQ ID NO: 7307 - protein, 189 aa, Artificial Sequence; identical to SEQ ID NO: 747
  Artificially synthesized modified ADAM10 peptide

SEQ ID NO: 7308 - protein, 189 aa, Artificial Sequence; identical to SEQ ID NO: 748
  Artificially synthesized modified ADAM10 peptide

SEQ ID NO: 7309 - protein, 189 aa, Artificial Sequence; identical to SEQ ID NO: 749
  Artificially synthesized modified ADAM10 peptide

SEQ ID NO: 7310 - protein, 189 aa, Artificial Sequence; identical to SEQ ID NO: 750
  Artificially synthesized modified ADAM10 peptide

SEQ ID NO: 7311 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 7312 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 7313 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 7314 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 7315 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 7316 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 7317 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 7318 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 7319 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 7320 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 7321 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 7322 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 7323 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 7324 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 7325 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 7326 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 7327 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 7328 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 7329 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 7330 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 7331 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 7332 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 7333 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 7334 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 7335 - protein, 189 aa, Artificial Sequence; identical to SEQ ID NO: 751
  Artificially synthesized modified ADAM10 peptide

SEQ ID NO: 7336 - protein, 189 aa, Artificial Sequence; identical to SEQ ID NO: 752
  Artificially synthesized modified ADAM10 peptide

SEQ ID NO: 7337 - protein, 189 aa, Artificial Sequence; identical to SEQ ID NO: 753
  Artificially synthesized modified ADAM10 peptide

SEQ ID NO: 7338 - protein, 189 aa, Artificial Sequence; identical to SEQ ID NO: 754
  Artificially synthesized modified ADAM10 peptide

SEQ ID NO: 7339 - protein, 189 aa, Artificial Sequence; identical to SEQ ID NO: 755
  Artificially synthesized modified ADAM10 peptide

SEQ ID NO: 7340 - protein, 189 aa, Artificial Sequence; identical to SEQ ID NO: 756
  Artificially synthesized modified ADAM10 peptide

SEQ ID NO: 7341 - protein, 189 aa, Artificial Sequence; identical to SEQ ID NO: 757
  Artificially synthesized modified ADAM10 peptide

SEQ ID NO: 7342 - protein, 189 aa, Artificial Sequence; identical to SEQ ID NO: 758
  Artificially synthesized modified ADAM10 peptide

SEQ ID NO: 7343 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 7344 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 7345 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 7346 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 7347 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 7348 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 7349 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 7350 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 7351 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 7352 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 7353 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 7354 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 7355 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 7356 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 7357 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 7358 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 7359 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 7360 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 7361 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 7362 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 7363 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 7364 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 7365 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 7366 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 7367 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 7368 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 7369 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 7370 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 7371 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 7372 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 7373 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 7374 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 7375 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 7376 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 7377 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 7378 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 7379 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 7380 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 7381 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 7382 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 7383 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

SEQ ID NO: 7384 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQEAHAANGPELLRK

SEQ ID NO: 7385 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAEHAANGPELLRK

SEQ ID NO: 7386 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPQAAHAANGPELLRK

SEQ ID NO: 7387 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEEHAANGPELLRK

SEQ ID NO: 7388 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAEAHAANGPELLRK

SEQ ID NO: 7389 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAEHAANGPELLRK

SEQ ID NO: 7390 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAEVTQIPAAAHAANGPELLRK

SEQ ID NO: 7391 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEEHAANGPELLRK

SEQ ID NO: 7392 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQEAHAANGPELLRK

SEQ ID NO: 7393 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAEHAANGPELLRK

SEQ ID NO: 7394 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPQAAHAANGPELLRK

SEQ ID NO: 7395 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEEHAANGPELLRK

SEQ ID NO: 7396 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAEAHAANGPELLRK

SEQ ID NO: 7397 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAEHAANGPELLRK

SEQ ID NO: 7398 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGCADHSVFERMRKYQMTGVAAVTQIPAAAHAANGPELLRK

SEQ ID NO: 7399 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEEHAANGPELLRK

SEQ ID NO: 7400 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQEAHAANGPELLRK

SEQ ID NO: 7401 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAEHAANGPELLRK

SEQ ID NO: 7402 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPQAAHAANGPELLRK

SEQ ID NO: 7403 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEEHAANGPELLRK

SEQ ID NO: 7404 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAEAHAANGPELLRK

SEQ ID NO: 7405 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAEHAANGPELLRK

SEQ ID NO: 7406 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEEVTQIPAAAHAANGPELLRK

SEQ ID NO: 7407 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEEHAANGPELLRK

SEQ ID NO: 7408 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQEAHAANGPELLRK

SEQ ID NO: 7409 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAEHAANGPELLRK

SEQ ID NO: 7410 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPQAAHAANGPELLRK

SEQ ID NO: 7411 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEEHAANGPELLRK

SEQ ID NO: 7412 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAEAHAANGPELLRK

SEQ ID NO: 7413 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAEHAANGPELLRK

SEQ ID NO: 7414 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVEAVTQIPAAAHAANGPELLRK

SEQ ID NO: 7415 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEEHAANGPELLRK

SEQ ID NO: 7416 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQEAHAANGPELLRK

SEQ ID NO: 7417 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAEHAANGPELLRK

SEQ ID NO: 7418 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPQAAHAANGPELLRK

SEQ ID NO: 7419 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEEHAANGPELLRK

SEQ ID NO: 7420 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAEAHAANGPELLRK

SEQ ID NO: 7421 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAEHAANGPELLRK

SEQ ID NO: 7422 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAEVTQIPAAAHAANGPELLRK

SEQ ID NO: 7423 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEEHAANGPELLRK

SEQ ID NO: 7424 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQEAHAANGPELLRK

SEQ ID NO: 7425 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAEHAANGPELLRK

SEQ ID NO: 7426 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPQAAHAANGPELLRK

SEQ ID NO: 7427 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEEHAANGPELLRK

SEQ ID NO: 7428 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAEAHAANGPELLRK

SEQ ID NO: 7429 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAEHAANGPELLRK

SEQ ID NO: 7430 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEDAINYPHKYGPQGGSADHSVFERMRKYQMTGVAAVTQIPAAAHAANGPELLRK

SEQ ID NO: 7431 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEEHAANGPELLRK

SEQ ID NO: 7432 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQEAHAANGPELLRK

SEQ ID NO: 7433 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAEHAANGPELLRK

SEQ ID NO: 7434 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPQAAHAANGPELLRK

SEQ ID NO: 7435 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEEHAANGPELLRK

SEQ ID NO: 7436 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAEAHAANGPELLRK

SEQ ID NO: 7437 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAEHAANGPELLRK

SEQ ID NO: 7438 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEEVTQIPAAAHAANGPELLRK

SEQ ID NO: 7439 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEEHAANGPELLRK

SEQ ID NO: 7440 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQEAHAANGPELLRK

SEQ ID NO: 7441 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAEHAANGPELLRK

SEQ ID NO: 7442 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPQAAHAANGPELLRK

SEQ ID NO: 7443 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEEHAANGPELLRK

SEQ ID NO: 7444 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAEAHAANGPELLRK

SEQ ID NO: 7445 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAEHAANGPELLRK

SEQ ID NO: 7446 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVEAVTQIPAAAHAANGPELLRK

SEQ ID NO: 7447 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEEHAANGPELLRK

SEQ ID NO: 7448 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQEAHAANGPELLRK

SEQ ID NO: 7449 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAEHAANGPELLRK

SEQ ID NO: 7450 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPQAAHAANGPELLRK

SEQ ID NO: 7451 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEEHAANGPELLRK

SEQ ID NO: 7452 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAEAHAANGPELLRK

SEQ ID NO: 7453 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAEHAANGPELLRK

SEQ ID NO: 7454 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAEVTQIPAAAHAANGPELLRK

SEQ ID NO: 7455 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEEHAANGPELLRK

SEQ ID NO: 7456 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQEAHAANGPELLRK

SEQ ID NO: 7457 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAEHAANGPELLRK

SEQ ID NO: 7458 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPQAAHAANGPELLRK

SEQ ID NO: 7459 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEEHAANGPELLRK

SEQ ID NO: 7460 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAEAHAANGPELLRK

SEQ ID NO: 7461 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAEHAANGPELLRK

SEQ ID NO: 7462 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGCADHSVFERMRKYQMTGVAAVTQIPAAAHAANGPELLRK

SEQ ID NO: 7463 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEEHAANGPELLRK

SEQ ID NO: 7464 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQEAHAANGPELLRK

SEQ ID NO: 7465 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAEHAANGPELLRK

SEQ ID NO: 7466 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPQAAHAANGPELLRK

SEQ ID NO: 7467 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEEHAANGPELLRK

SEQ ID NO: 7468 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAEAHAANGPELLRK

SEQ ID NO: 7469 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAEHAANGPELLRK

SEQ ID NO: 7470 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEEVTQIPAAAHAANGPELLRK

SEQ ID NO: 7471 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEEHAANGPELLRK

SEQ ID NO: 7472 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQEAHAANGPELLRK

SEQ ID NO: 7473 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAEHAANGPELLRK

SEQ ID NO: 7474 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPQAAHAANGPELLRK

SEQ ID NO: 7475 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEEHAANGPELLRK

SEQ ID NO: 7476 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAEAHAANGPELLRK

SEQ ID NO: 7477 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAEHAANGPELLRK

SEQ ID NO: 7478 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVEAVTQIPAAAHAANGPELLRK

SEQ ID NO: 7479 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEEHAANGPELLRK

SEQ ID NO: 7480 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQEAHAANGPELLRK

SEQ ID NO: 7481 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAEHAANGPELLRK

SEQ ID NO: 7482 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPQAAHAANGPELLRK

SEQ ID NO: 7483 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEEHAANGPELLRK

SEQ ID NO: 7484 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAEAHAANGPELLRK

SEQ ID NO: 7485 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAEHAANGPELLRK

SEQ ID NO: 7486 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAEVTQIPAAAHAANGPELLRK

SEQ ID NO: 7487 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEEHAANGPELLRK

SEQ ID NO: 7488 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQEAHAANGPELLRK

SEQ ID NO: 7489 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAEHAANGPELLRK

SEQ ID NO: 7490 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPQAAHAANGPELLRK

SEQ ID NO: 7491 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEEHAANGPELLRK

SEQ ID NO: 7492 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAEAHAANGPELLRK

SEQ ID NO: 7493 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAEHAANGPELLRK

SEQ ID NO: 7494 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEADINYPHKYGPQGGSADHSVFERMRKYQMTGVAAVTQIPAAAHAANGPELLRK

SEQ ID NO: 7495 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEEHAANGPELLRK

SEQ ID NO: 7496 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQEAHAANGPELLRK

SEQ ID NO: 7497 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAEHAANGPELLRK

SEQ ID NO: 7498 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPQAAHAANGPELLRK

SEQ ID NO: 7499 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEEHAANGPELLRK

SEQ ID NO: 7500 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAEAHAANGPELLRK

SEQ ID NO: 7501 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAEHAANGPELLRK

SEQ ID NO: 7502 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEEVTQIPAAAHAANGPELLRK

SEQ ID NO: 7503 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEEHAANGPELLRK

SEQ ID NO: 7504 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQEAHAANGPELLRK

SEQ ID NO: 7505 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAEHAANGPELLRK

SEQ ID NO: 7506 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPQAAHAANGPELLRK

SEQ ID NO: 7507 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEEHAANGPELLRK

SEQ ID NO: 7508 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAEAHAANGPELLRK

SEQ ID NO: 7509 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAEHAANGPELLRK

SEQ ID NO: 7510 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVEAVTQIPAAAHAANGPELLRK

SEQ ID NO: 7511 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEEHAANGPELLRK

SEQ ID NO: 7512 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQEAHAANGPELLRK

SEQ ID NO: 7513 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAEHAANGPELLRK

SEQ ID NO: 7514 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPQAAHAANGPELLRK

SEQ ID NO: 7515 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEEHAANGPELLRK

SEQ ID NO: 7516 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAEAHAANGPELLRK

SEQ ID NO: 7517 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAEHAANGPELLRK

SEQ ID NO: 7518 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAEVTQIPAAAHAANGPELLRK

SEQ ID NO: 7519 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEEHAANGPELLRK

SEQ ID NO: 7520 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQEAHAANGPELLRK

SEQ ID NO: 7521 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAEHAANGPELLRK

SEQ ID NO: 7522 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPQAAHAANGPELLRK

SEQ ID NO: 7523 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEEHAANGPELLRK

SEQ ID NO: 7524 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAEAHAANGPELLRK

SEQ ID NO: 7525 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAEHAANGPELLRK

SEQ ID NO: 7526 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGCADHSVFERMRKYQMTGVAAVTQIPAAAHAANGPELLRK

SEQ ID NO: 7527 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEEHAANGPELLRK

SEQ ID NO: 7528 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQEAHAANGPELLRK

SEQ ID NO: 7529 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAEHAANGPELLRK

SEQ ID NO: 7530 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPQAAHAANGPELLRK

SEQ ID NO: 7531 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEEHAANGPELLRK

SEQ ID NO: 7532 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAEAHAANGPELLRK

SEQ ID NO: 7533 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAEHAANGPELLRK

SEQ ID NO: 7534 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEEVTQIPAAAHAANGPELLRK

SEQ ID NO: 7535 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEEHAANGPELLRK

SEQ ID NO: 7536 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQEAHAANGPELLRK

SEQ ID NO: 7537 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAEHAANGPELLRK

SEQ ID NO: 7538 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPQAAHAANGPELLRK

SEQ ID NO: 7539 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEEHAANGPELLRK

SEQ ID NO: 7540 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAEAHAANGPELLRK

SEQ ID NO: 7541 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAEHAANGPELLRK

SEQ ID NO: 7542 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVEAVTQIPAAAHAANGPELLRK

SEQ ID NO: 7543 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEEHAANGPELLRK

SEQ ID NO: 7544 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQEAHAANGPELLRK

SEQ ID NO: 7545 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAEHAANGPELLRK

SEQ ID NO: 7546 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPQAAHAANGPELLRK

SEQ ID NO: 7547 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEEHAANGPELLRK

SEQ ID NO: 7548 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAEAHAANGPELLRK

SEQ ID NO: 7549 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAEHAANGPELLRK

SEQ ID NO: 7550 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAEVTQIPAAAHAANGPELLRK

SEQ ID NO: 7551 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEEHAANGPELLRK

SEQ ID NO: 7552 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQEAHAANGPELLRK

SEQ ID NO: 7553 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAEHAANGPELLRK

SEQ ID NO: 7554 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPQAAHAANGPELLRK

SEQ ID NO: 7555 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEEHAANGPELLRK

SEQ ID NO: 7556 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAEAHAANGPELLRK

SEQ ID NO: 7557 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAEHAANGPELLRK

SEQ ID NO: 7558 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHEAAINYPHKYGPQGGSADHSVFERMRKYQMTGVAAVTQIPAAAHAANGPELLRK

SEQ ID NO: 7559 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEEHAANGPELLRK

SEQ ID NO: 7560 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQEAHAANGPELLRK

SEQ ID NO: 7561 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAEHAANGPELLRK

SEQ ID NO: 7562 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPQAAHAANGPELLRK

SEQ ID NO: 7563 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEEHAANGPELLRK

SEQ ID NO: 7564 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAEAHAANGPELLRK

SEQ ID NO: 7565 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAEHAANGPELLRK

SEQ ID NO: 7566 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEEVTQIPAAAHAANGPELLRK

SEQ ID NO: 7567 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEEHAANGPELLRK

SEQ ID NO: 7568 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQEAHAANGPELLRK

SEQ ID NO: 7569 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAEHAANGPELLRK

SEQ ID NO: 7570 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPQAAHAANGPELLRK

SEQ ID NO: 7571 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEEHAANGPELLRK

SEQ ID NO: 7572 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAEAHAANGPELLRK

SEQ ID NO: 7573 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAEHAANGPELLRK

SEQ ID NO: 7574 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVEAVTQIPAAAHAANGPELLRK

SEQ ID NO: 7575 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEEHAANGPELLRK

SEQ ID NO: 7576 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQEAHAANGPELLRK

SEQ ID NO: 7577 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAEHAANGPELLRK

SEQ ID NO: 7578 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPQAAHAANGPELLRK

SEQ ID NO: 7579 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEEHAANGPELLRK

SEQ ID NO: 7580 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAEAHAANGPELLRK

SEQ ID NO: 7581 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAEHAANGPELLRK

SEQ ID NO: 7582 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAEVTQIPAAAHAANGPELLRK

SEQ ID NO: 7583 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEEHAANGPELLRK

SEQ ID NO: 7584 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQEAHAANGPELLRK

SEQ ID NO: 7585 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAEHAANGPELLRK

SEQ ID NO: 7586 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPQAAHAANGPELLRK

SEQ ID NO: 7587 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEEHAANGPELLRK

SEQ ID NO: 7588 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAEAHAANGPELLRK

SEQ ID NO: 7589 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAEHAANGPELLRK

SEQ ID NO: 7590 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGCADHSVFERMRKYQMTGVAAVTQIPAAAHAANGPELLRK

SEQ ID NO: 7591 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEEHAANGPELLRK

SEQ ID NO: 7592 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQEAHAANGPELLRK

SEQ ID NO: 7593 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAEHAANGPELLRK

SEQ ID NO: 7594 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPQAAHAANGPELLRK

SEQ ID NO: 7595 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEEHAANGPELLRK

SEQ ID NO: 7596 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAEAHAANGPELLRK

SEQ ID NO: 7597 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAEHAANGPELLRK

SEQ ID NO: 7598 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEEVTQIPAAAHAANGPELLRK

SEQ ID NO: 7599 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEEHAANGPELLRK

SEQ ID NO: 7600 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQEAHAANGPELLRK

SEQ ID NO: 7601 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAEHAANGPELLRK

SEQ ID NO: 7602 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPQAAHAANGPELLRK

SEQ ID NO: 7603 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEEHAANGPELLRK

SEQ ID NO: 7604 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAEAHAANGPELLRK

SEQ ID NO: 7605 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAEHAANGPELLRK

SEQ ID NO: 7606 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVEAVTQIPAAAHAANGPELLRK

SEQ ID NO: 7607 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEEHAANGPELLRK

SEQ ID NO: 7608 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQEAHAANGPELLRK

SEQ ID NO: 7609 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAEHAANGPELLRK

SEQ ID NO: 7610 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPQAAHAANGPELLRK

SEQ ID NO: 7611 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEEHAANGPELLRK

SEQ ID NO: 7612 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAEAHAANGPELLRK

SEQ ID NO: 7613 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAEHAANGPELLRK

SEQ ID NO: 7614 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAEVTQIPAAAHAANGPELLRK

SEQ ID NO: 7615 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEEHAANGPELLRK

SEQ ID NO: 7616 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQEAHAANGPELLRK

SEQ ID NO: 7617 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAEHAANGPELLRK

SEQ ID NO: 7618 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPQAAHAANGPELLRK

SEQ ID NO: 7619 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEEHAANGPELLRK

SEQ ID NO: 7620 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAEAHAANGPELLRK

SEQ ID NO: 7621 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAEHAANGPELLRK

SEQ ID NO: 7622 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADDINYPHKYGPQGGSADHSVFERMRKYQMTGVAAVTQIPAAAHAANGPELLRK

SEQ ID NO: 7623 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEEHAANGPELLRK

SEQ ID NO: 7624 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQEAHAANGPELLRK

SEQ ID NO: 7625 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAEHAANGPELLRK

SEQ ID NO: 7626 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPQAAHAANGPELLRK

SEQ ID NO: 7627 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEEHAANGPELLRK

SEQ ID NO: 7628 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAEAHAANGPELLRK

SEQ ID NO: 7629 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAEHAANGPELLRK

SEQ ID NO: 7630 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEEVTQIPAAAHAANGPELLRK

SEQ ID NO: 7631 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEEHAANGPELLRK

SEQ ID NO: 7632 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQEAHAANGPELLRK

SEQ ID NO: 7633 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAEHAANGPELLRK

SEQ ID NO: 7634 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPQAAHAANGPELLRK

SEQ ID NO: 7635 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEEHAANGPELLRK

SEQ ID NO: 7636 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAEAHAANGPELLRK

SEQ ID NO: 7637 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAEHAANGPELLRK

SEQ ID NO: 7638 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVEAVTQIPAAAHAANGPELLRK

SEQ ID NO: 7639 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEEHAANGPELLRK

SEQ ID NO: 7640 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQEAHAANGPELLRK

SEQ ID NO: 7641 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAEHAANGPELLRK

SEQ ID NO: 7642 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPQAAHAANGPELLRK

SEQ ID NO: 7643 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEEHAANGPELLRK

SEQ ID NO: 7644 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAEAHAANGPELLRK

SEQ ID NO: 7645 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAEHAANGPELLRK

SEQ ID NO: 7646 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAEVTQIPAAAHAANGPELLRK

SEQ ID NO: 7647 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEEHAANGPELLRK

SEQ ID NO: 7648 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQEAHAANGPELLRK

SEQ ID NO: 7649 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAEHAANGPELLRK

SEQ ID NO: 7650 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPQAAHAANGPELLRK

SEQ ID NO: 7651 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEEHAANGPELLRK

SEQ ID NO: 7652 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAEAHAANGPELLRK

SEQ ID NO: 7653 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAEHAANGPELLRK

SEQ ID NO: 7654 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGCADHSVFERMRKYQMTGVAAVTQIPAAAHAANGPELLRK

SEQ ID NO: 7655 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEEHAANGPELLRK

SEQ ID NO: 7656 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQEAHAANGPELLRK

SEQ ID NO: 7657 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAEHAANGPELLRK

SEQ ID NO: 7658 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPQAAHAANGPELLRK

SEQ ID NO: 7659 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEEHAANGPELLRK

SEQ ID NO: 7660 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAEAHAANGPELLRK

SEQ ID NO: 7661 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAEHAANGPELLRK

SEQ ID NO: 7662 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEEVTQIPAAAHAANGPELLRK

SEQ ID NO: 7663 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEEHAANGPELLRK

SEQ ID NO: 7664 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQEAHAANGPELLRK

SEQ ID NO: 7665 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAEHAANGPELLRK

SEQ ID NO: 7666 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPQAAHAANGPELLRK

SEQ ID NO: 7667 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEEHAANGPELLRK

SEQ ID NO: 7668 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAEAHAANGPELLRK

SEQ ID NO: 7669 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAEHAANGPELLRK

SEQ ID NO: 7670 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVEAVTQIPAAAHAANGPELLRK

SEQ ID NO: 7671 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEEHAANGPELLRK

SEQ ID NO: 7672 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQEAHAANGPELLRK

SEQ ID NO: 7673 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAEHAANGPELLRK

SEQ ID NO: 7674 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPQAAHAANGPELLRK

SEQ ID NO: 7675 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEEHAANGPELLRK

SEQ ID NO: 7676 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAEAHAANGPELLRK

SEQ ID NO: 7677 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAEHAANGPELLRK

SEQ ID NO: 7678 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAEVTQIPAAAHAANGPELLRK

SEQ ID NO: 7679 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEEHAANGPELLRK

SEQ ID NO: 7680 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQEAHAANGPELLRK

SEQ ID NO: 7681 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAEHAANGPELLRK

SEQ ID NO: 7682 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPQAAHAANGPELLRK

SEQ ID NO: 7683 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEEHAANGPELLRK

SEQ ID NO: 7684 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAEAHAANGPELLRK

SEQ ID NO: 7685 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAEHAANGPELLRK

SEQ ID NO: 7686 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHADAINYPHKYGPQGGSADHSVFERMRKYQMTGVAAVTQIPAAAHAANGPELLRK

SEQ ID NO: 7687 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEEHAANGPELLRK

SEQ ID NO: 7688 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQEAHAANGPELLRK

SEQ ID NO: 7689 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAEHAANGPELLRK

SEQ ID NO: 7690 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPQAAHAANGPELLRK

SEQ ID NO: 7691 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEEHAANGPELLRK

SEQ ID NO: 7692 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAEAHAANGPELLRK

SEQ ID NO: 7693 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAEHAANGPELLRK

SEQ ID NO: 7694 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEEVTQIPAAAHAANGPELLRK

SEQ ID NO: 7695 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEEHAANGPELLRK

SEQ ID NO: 7696 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQEAHAANGPELLRK

SEQ ID NO: 7697 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAEHAANGPELLRK

SEQ ID NO: 7698 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPQAAHAANGPELLRK

SEQ ID NO: 7699 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEEHAANGPELLRK

SEQ ID NO: 7700 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAEAHAANGPELLRK

SEQ ID NO: 7701 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAEHAANGPELLRK

SEQ ID NO: 7702 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVEAVTQIPAAAHAANGPELLRK

SEQ ID NO: 7703 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEEHAANGPELLRK

SEQ ID NO: 7704 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQEAHAANGPELLRK

SEQ ID NO: 7705 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAEHAANGPELLRK

SEQ ID NO: 7706 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPQAAHAANGPELLRK

SEQ ID NO: 7707 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEEHAANGPELLRK

SEQ ID NO: 7708 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAEAHAANGPELLRK

SEQ ID NO: 7709 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAEHAANGPELLRK

SEQ ID NO: 7710 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAEVTQIPAAAHAANGPELLRK

SEQ ID NO: 7711 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEEHAANGPELLRK

SEQ ID NO: 7712 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQEAHAANGPELLRK

SEQ ID NO: 7713 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAEHAANGPELLRK

SEQ ID NO: 7714 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPQAAHAANGPELLRK

SEQ ID NO: 7715 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEEHAANGPELLRK

SEQ ID NO: 7716 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAEAHAANGPELLRK

SEQ ID NO: 7717 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAEHAANGPELLRK

SEQ ID NO: 7718 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGCADHSVFERMRKYQMTGVAAVTQIPAAAHAANGPELLRK

SEQ ID NO: 7719 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEEHAANGPELLRK

SEQ ID NO: 7720 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQEAHAANGPELLRK

SEQ ID NO: 7721 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAEHAANGPELLRK

SEQ ID NO: 7722 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPQAAHAANGPELLRK

SEQ ID NO: 7723 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEEHAANGPELLRK

SEQ ID NO: 7724 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAEAHAANGPELLRK

SEQ ID NO: 7725 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAEHAANGPELLRK

SEQ ID NO: 7726 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEEVTQIPAAAHAANGPELLRK

SEQ ID NO: 7727 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEEHAANGPELLRK

SEQ ID NO: 7728 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQEAHAANGPELLRK

SEQ ID NO: 7729 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAEHAANGPELLRK

SEQ ID NO: 7730 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPQAAHAANGPELLRK

SEQ ID NO: 7731 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEEHAANGPELLRK

SEQ ID NO: 7732 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAEAHAANGPELLRK

SEQ ID NO: 7733 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAEHAANGPELLRK

SEQ ID NO: 7734 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVEAVTQIPAAAHAANGPELLRK

SEQ ID NO: 7735 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEEHAANGPELLRK

SEQ ID NO: 7736 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQEAHAANGPELLRK

SEQ ID NO: 7737 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAEHAANGPELLRK

SEQ ID NO: 7738 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPQAAHAANGPELLRK

SEQ ID NO: 7739 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEEHAANGPELLRK

SEQ ID NO: 7740 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAEAHAANGPELLRK

SEQ ID NO: 7741 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAEHAANGPELLRK

SEQ ID NO: 7742 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAEVTQIPAAAHAANGPELLRK

SEQ ID NO: 7743 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEEHAANGPELLRK

SEQ ID NO: 7744 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQEAHAANGPELLRK

SEQ ID NO: 7745 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAEHAANGPELLRK

SEQ ID NO: 7746 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPQAAHAANGPELLRK

SEQ ID NO: 7747 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEEHAANGPELLRK

SEQ ID NO: 7748 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAEAHAANGPELLRK

SEQ ID NO: 7749 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAEHAANGPELLRK

SEQ ID NO: 7750 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAADINYPHKYGPQGGSADHSVFERMRKYQMTGVAAVTQIPAAAHAANGPELLRK

SEQ ID NO: 7751 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEEHAANGPELLRK

SEQ ID NO: 7752 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQEAHAANGPELLRK

SEQ ID NO: 7753 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAEHAANGPELLRK

SEQ ID NO: 7754 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPQAAHAANGPELLRK

SEQ ID NO: 7755 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEEHAANGPELLRK

SEQ ID NO: 7756 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAEAHAANGPELLRK

SEQ ID NO: 7757 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAEHAANGPELLRK

SEQ ID NO: 7758 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEEVTQIPAAAHAANGPELLRK

SEQ ID NO: 7759 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEEHAANGPELLRK

SEQ ID NO: 7760 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQEAHAANGPELLRK

SEQ ID NO: 7761 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAEHAANGPELLRK

SEQ ID NO: 7762 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPQAAHAANGPELLRK

SEQ ID NO: 7763 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEEHAANGPELLRK

SEQ ID NO: 7764 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAEAHAANGPELLRK

SEQ ID NO: 7765 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAEHAANGPELLRK

SEQ ID NO: 7766 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVEAVTQIPAAAHAANGPELLRK

SEQ ID NO: 7767 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEEHAANGPELLRK

SEQ ID NO: 7768 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQEAHAANGPELLRK

SEQ ID NO: 7769 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAEHAANGPELLRK

SEQ ID NO: 7770 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPQAAHAANGPELLRK

SEQ ID NO: 7771 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEEHAANGPELLRK

SEQ ID NO: 7772 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAEAHAANGPELLRK

SEQ ID NO: 7773 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAEHAANGPELLRK

SEQ ID NO: 7774 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAEVTQIPAAAHAANGPELLRK

SEQ ID NO: 7775 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEEHAANGPELLRK

SEQ ID NO: 7776 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQEAHAANGPELLRK

SEQ ID NO: 7777 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAEHAANGPELLRK

SEQ ID NO: 7778 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPQAAHAANGPELLRK

SEQ ID NO: 7779 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEEHAANGPELLRK

SEQ ID NO: 7780 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAEAHAANGPELLRK

SEQ ID NO: 7781 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAEHAANGPELLRK

SEQ ID NO: 7782 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGCADHSVFERMRKYQMTGVAAVTQIPAAAHAANGPELLRK

SEQ ID NO: 7783 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEEHAANGPELLRK

SEQ ID NO: 7784 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQEAHAANGPELLRK

SEQ ID NO: 7785 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAEHAANGPELLRK

SEQ ID NO: 7786 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPQAAHAANGPELLRK

SEQ ID NO: 7787 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEEHAANGPELLRK

SEQ ID NO: 7788 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAEAHAANGPELLRK

SEQ ID NO: 7789 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAEHAANGPELLRK

SEQ ID NO: 7790 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEEVTQIPAAAHAANGPELLRK

SEQ ID NO: 7791 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEEHAANGPELLRK

SEQ ID NO: 7792 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQEAHAANGPELLRK

SEQ ID NO: 7793 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAEHAANGPELLRK

SEQ ID NO: 7794 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPQAAHAANGPELLRK

SEQ ID NO: 7795 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEEHAANGPELLRK

SEQ ID NO: 7796 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAEAHAANGPELLRK

SEQ ID NO: 7797 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAEHAANGPELLRK

SEQ ID NO: 7798 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVEAVTQIPAAAHAANGPELLRK

SEQ ID NO: 7799 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEEHAANGPELLRK

SEQ ID NO: 7800 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQEAHAANGPELLRK

SEQ ID NO: 7801 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAEHAANGPELLRK

SEQ ID NO: 7802 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPQAAHAANGPELLRK

SEQ ID NO: 7803 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEEHAANGPELLRK

SEQ ID NO: 7804 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAEAHAANGPELLRK

SEQ ID NO: 7805 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAEHAANGPELLRK

SEQ ID NO: 7806 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAEVTQIPAAAHAANGPELLRK

SEQ ID NO: 7807 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEEHAANGPELLRK

SEQ ID NO: 7808 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQEAHAANGPELLRK

SEQ ID NO: 7809 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAEHAANGPELLRK

SEQ ID NO: 7810 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPQAAHAANGPELLRK

SEQ ID NO: 7811 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEEHAANGPELLRK

SEQ ID NO: 7812 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAEAHAANGPELLRK

SEQ ID NO: 7813 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAEHAANGPELLRK

SEQ ID NO: 7814 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAEGSFSHGSVIDGRFEGFIQTRGGTFYVEPAERYIKDRTLPFHSVIYHAAAINYPHKYGPQGGSADHSVFERMRKYQMTGVAAVTQIPAAAHAANGPELLRK

SEQ ID NO: 7815 - protein, 189 aa, Artificial Sequence; identical to SEQ ID NO: 759
  Artificially synthesized modified ADAM10 peptide

SEQ ID NO: 7816 - protein, 189 aa, Artificial Sequence; identical to SEQ ID NO: 760
  Artificially synthesized modified ADAM10 peptide

SEQ ID NO: 7817 - protein, 189 aa, Artificial Sequence; identical to SEQ ID NO: 761
  Artificially synthesized modified ADAM10 peptide

SEQ ID NO: 7818 - protein, 189 aa, Artificial Sequence; identical to SEQ ID NO: 762
  Artificially synthesized modified ADAM10 peptide

SEQ ID NO: 7819 - protein, 189 aa, Artificial Sequence; identical to SEQ ID NO: 763
  Artificially synthesized modified ADAM10 peptide

SEQ ID NO: 7820 - protein, 189 aa, Artificial Sequence; identical to SEQ ID NO: 764
  Artificially synthesized modified ADAM10 peptide

SEQ ID NO: 7821 - protein, 189 aa, Artificial Sequence; identical to SEQ ID NO: 765
  Artificially synthesized modified ADAM10 peptide

SEQ ID NO: 7822 - protein, 189 aa, Artificial Sequence; identical to SEQ ID NO: 766
  Artificially synthesized modified ADAM10 peptide

SEQ ID NO: 7823 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEEHAANGPELLRK

SEQ ID NO: 7824 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQEAHAANGPELLRK

SEQ ID NO: 7825 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAEHAANGPELLRK

SEQ ID NO: 7826 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPQAAHAANGPELLRK

SEQ ID NO: 7827 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEEHAANGPELLRK

SEQ ID NO: 7828 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAEAHAANGPELLRK

SEQ ID NO: 7829 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAEHAANGPELLRK

SEQ ID NO: 7830 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVEAVTQIPAAAHAANGPELLRK

SEQ ID NO: 7831 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEEHAANGPELLRK

SEQ ID NO: 7832 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQEAHAANGPELLRK

SEQ ID NO: 7833 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAEHAANGPELLRK

SEQ ID NO: 7834 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPQAAHAANGPELLRK

SEQ ID NO: 7835 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEEHAANGPELLRK

SEQ ID NO: 7836 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAEAHAANGPELLRK

SEQ ID NO: 7837 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAEHAANGPELLRK

SEQ ID NO: 7838 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAEVTQIPAAAHAANGPELLRK

SEQ ID NO: 7839 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEEHAANGPELLRK

SEQ ID NO: 7840 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQEAHAANGPELLRK

SEQ ID NO: 7841 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAEHAANGPELLRK

SEQ ID NO: 7842 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPQAAHAANGPELLRK

SEQ ID NO: 7843 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEEHAANGPELLRK

SEQ ID NO: 7844 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAEAHAANGPELLRK

SEQ ID NO: 7845 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAEHAANGPELLRK

SEQ ID NO: 7846 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGCADHSVFERMRKYQMTGVAAVTQIPAAAHAANGPELLRK

SEQ ID NO: 7847 - protein, 189 aa, Artificial Sequence; identical to SEQ ID NO: 767
  Artificially synthesized modified ADAM10 peptide

SEQ ID NO: 7848 - protein, 189 aa, Artificial Sequence; identical to SEQ ID NO: 768
  Artificially synthesized modified ADAM10 peptide

SEQ ID NO: 7849 - protein, 189 aa, Artificial Sequence; identical to SEQ ID NO: 769
  Artificially synthesized modified ADAM10 peptide

SEQ ID NO: 7850 - protein, 189 aa, Artificial Sequence; identical to SEQ ID NO: 770
  Artificially synthesized modified ADAM10 peptide

SEQ ID NO: 7851 - protein, 189 aa, Artificial Sequence; identical to SEQ ID NO: 771
  Artificially synthesized modified ADAM10 peptide

SEQ ID NO: 7852 - protein, 189 aa, Artificial Sequence; identical to SEQ ID NO: 772
  Artificially synthesized modified ADAM10 peptide

SEQ ID NO: 7853 - protein, 189 aa, Artificial Sequence; identical to SEQ ID NO: 773
  Artificially synthesized modified ADAM10 peptide

SEQ ID NO: 7854 - protein, 189 aa, Artificial Sequence; identical to SEQ ID NO: 774
  Artificially synthesized modified ADAM10 peptide

SEQ ID NO: 7855 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEEHAANGPELLRK

SEQ ID NO: 7856 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQEAHAANGPELLRK

SEQ ID NO: 7857 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAEHAANGPELLRK

SEQ ID NO: 7858 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPQAAHAANGPELLRK

SEQ ID NO: 7859 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEEHAANGPELLRK

SEQ ID NO: 7860 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAEAHAANGPELLRK

SEQ ID NO: 7861 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAEHAANGPELLRK

SEQ ID NO: 7862 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVEAVTQIPAAAHAANGPELLRK

SEQ ID NO: 7863 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEEHAANGPELLRK

SEQ ID NO: 7864 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQEAHAANGPELLRK

SEQ ID NO: 7865 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAEHAANGPELLRK

SEQ ID NO: 7866 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPQAAHAANGPELLRK

SEQ ID NO: 7867 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEEHAANGPELLRK

SEQ ID NO: 7868 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAEAHAANGPELLRK

SEQ ID NO: 7869 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAEHAANGPELLRK

SEQ ID NO: 7870 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAEVTQIPAAAHAANGPELLRK

SEQ ID NO: 7871 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEEHAANGPELLRK

SEQ ID NO: 7872 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQEAHAANGPELLRK

SEQ ID NO: 7873 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAEHAANGPELLRK

SEQ ID NO: 7874 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPQAAHAANGPELLRK

SEQ ID NO: 7875 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEEHAANGPELLRK

SEQ ID NO: 7876 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAEAHAANGPELLRK

SEQ ID NO: 7877 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAEHAANGPELLRK

SEQ ID NO: 7878 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDDINYPHKYGPQGGSADHSVFERMRKYQMTGVAAVTQIPAAAHAANGPELLRK

SEQ ID NO: 7879 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEEHAANGPELLRK

SEQ ID NO: 7880 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQEAHAANGPELLRK

SEQ ID NO: 7881 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAEHAANGPELLRK

SEQ ID NO: 7882 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPQAAHAANGPELLRK

SEQ ID NO: 7883 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEEHAANGPELLRK

SEQ ID NO: 7884 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAEAHAANGPELLRK

SEQ ID NO: 7885 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAEHAANGPELLRK

SEQ ID NO: 7886 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEEVTQIPAAAHAANGPELLRK

SEQ ID NO: 7887 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEEHAANGPELLRK

SEQ ID NO: 7888 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQEAHAANGPELLRK

SEQ ID NO: 7889 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAEHAANGPELLRK

SEQ ID NO: 7890 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPQAAHAANGPELLRK

SEQ ID NO: 7891 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEEHAANGPELLRK

SEQ ID NO: 7892 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAEAHAANGPELLRK

SEQ ID NO: 7893 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAEHAANGPELLRK

SEQ ID NO: 7894 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVEAVTQIPAAAHAANGPELLRK

SEQ ID NO: 7895 - protein, 189 aa, Artificial Sequence
  Artificially synthesized modified ADAM10 peptide
NPLNKYIRHYEGLSYNVDSLHQKHQRAKAAVSHEDQFLRLDFHAHGRHFNLRMKADTSLFSDEFKVETSNKVLDYDTSHIYTGHIYGAAGSFSHGSVIDGRFEGFIQTRGGTFYVEPAERYIKDRTLPFHSVIYHEDAINYPHKYGPQGGCADHSVFERMRKYQMTGVAEVTQIPQEEHAANGPELLRK

(The sequence listing continues in the following parts.)

What is claimed is:

1. A peptide comprising an amino acid sequence at least 90% identical to SEQ ID NO: 62, wherein amino acid position number 29 is not arginine, amino acid position number 55 is not arginine, amino acid position number 151 is not cysteine, and amino acid position number 177 is not glutamine.

2. The peptide of claim 1, wherein the amino acid at position number 29 is alanine.

3. The peptide of claim 1, wherein the amino acid at position number 29 is glycine.

4. The peptide of claim 3, wherein the amino acid at position number 55 is glycine.

5. The peptide of claim 4, wherein the amino acid at position number 151 is serine.

6. The peptide of claim 5, wherein the amino acid at position number 177 is alanine.

7. The peptide of claim 6, which comprises an amino acid sequence at least 95% identical to SEQ ID NO: 62.

8. The peptide of claim 4, wherein the amino acid at position number 177 is alanine.

9. The peptide of claim 3, wherein the amino acid at position number 151 is serine.

10. The peptide of claim 3, wherein the amino acid at position number 177 is alanine.

11. The peptide of claim 1, wherein the amino acid at position number 55 is alanine.

12. The peptide of claim 1, wherein the amino acid at position number 55 is glycine.

13. The peptide of claim 12, wherein the amino acid at position number 151 is serine.

14. The peptide of claim 12, wherein the amino acid at position number 177 is alanine.

15. The peptide of claim 1, wherein the amino acid at position number 151 is serine.

16. The peptide of claim 1, wherein the amino acid at position number 177 is alanine.

17. The peptide of claim 1, which comprises the amino acid sequence of SEQ ID NO: 3 in which position 26 is arginine, position 27 is alanine, position 28 is lysine, position 29 is glycine, position 34 is glutamic acid, position 35 is aspartic acid, position 36 is glutamine, position 52 is arginine, position 53 is methionine, position 54 is lysine, position 55 is alanine, position 62 is aspartic acid, position 63 is glutamic acid, position 88 is glutamic acid, position 89 is glutamic acid, position 136 is glutamic acid, position 137 is aspartic acid, position 138 is aspartic acid, position 151 is serine, position 169 is glutamic acid, position 170 is glutamic acid, position 176 is glutamine, position 177 is alanine, and position 178 is glutamic acid.

18. A pharmaceutical composition comprising the peptide of claim 1 and a pharmaceutically acceptable carrier or excipient.

19. A method of inhibiting A Disintegrin and metalloproteinase domain-containing protein 10 (ADAM10) activity comprising administering the peptide of claim 1 to a human subject in need thereof.

* * * * *